United States Patent 12,508,308 (INFLUENZA mRNA VACCINES) - sequence listing, part 44

SEQ ID NO: 168931 - RNA, 1410 nt, Artificial Sequence
  derived and/or modified sequence opt4 from neuraminidase__InfluenzaA__ACD85234
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccgacggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168932 - RNA, 1410 nt, Artificial Sequence
  derived and/or modified sequence opt4 from neuraminidase__InfluenzaA__ACD85245
augaaccccaaccagaagaucaucaccaucggcagcgugagccugaucaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccagagugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacgacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168933 - RNA, 1410 nt, Artificial Sequence
  derived and/or modified sequence opt4 from neuraminidase__InfluenzaA__ACD85454
augaaccccaaccagaagaucaucaccaucggcagcgugagccugaccaucagcaccaucggcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168934 - RNA, 1410 nt, Artificial Sequence
  derived and/or modified sequence opt4 from neuraminidase__InfluenzaA__ACD85465
augaaccccaaccagaagaucaucaccaucggcagcgugagccugaccaucagcaccaucggcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168935 - RNA, 1410 nt, Artificial Sequence
  derived and/or modified sequence opt4 from neuraminidase__InfluenzaA__ACD85487
augaaccccaaccagaagaucaucaccaucggcagcgugagccugaucaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168936 - RNA, 1410 nt, Artificial Sequence
  derived and/or modified sequence opt4 from neuraminidase__InfluenzaA__ACD85498
augaaccccaaccagaagaucaucaccaucggcagcgugagccugaucaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168937 - RNA, 1410 nt, Artificial Sequence
  derived and/or modified sequence opt4 from neuraminidase__InfluenzaA__ACD85509
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcagcagaggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168938 - RNA, 1410 nt, Artificial Sequence
  derived and/or modified sequence opt4 from neuraminidase__InfluenzaA__ACD85520
augaaccccaaccagaagaucaucaccaucggcagcgugagccugaucaucagcaccaucggcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168939 - RNA, 1410 nt, Artificial Sequence; identical to SEQ ID NO: 168934
  derived and/or modified sequence opt4 from neuraminidase__InfluenzaA__ACD85553

SEQ ID NO: 168940 - RNA, 1410 nt, Artificial Sequence
  derived and/or modified sequence opt4 from neuraminidase__InfluenzaA__ACD85564
augaaccccaaccagaagaucaucaccaucggcagcgugagccugaucaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaccgcccaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168941 - RNA, 1410 nt, Artificial Sequence
  derived and/or modified sequence opt4 from neuraminidase__InfluenzaA__ACD85575
augaaccccaaccagaagaucaucaccaucggcagcgugagccugaucaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168942 - RNA, 1410 nt, Artificial Sequence
  derived and/or modified sequence opt4 from neuraminidase__InfluenzaA__ACD85586
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggcagaggcgugaagggcugggccuucgacgacggcaacgacguguggaugggcagaaccaucagcgagaagagcagacugggcuacgagaccuucaaggugaucgagggcuggagcaaccccaagagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168943 - RNA, 1410 nt, Artificial Sequence
  derived and/or modified sequence opt4 from neuraminidase__InfluenzaA__ACD93582
augaaccccaaccagaagaucaucaccaucggcagcgugagccugaccaucagcaccaucugcuucuucaugcagaucgccauccuggccaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168944 - RNA, 1410 nt, Artificial Sequence; identical to SEQ ID NO: 167232
  derived and/or modified sequence opt4 from neuraminidase__InfluenzaA__ACF09403

SEQ ID NO: 168945 - RNA, 1410 nt, Artificial Sequence; identical to SEQ ID NO: 168449
  derived and/or modified sequence opt4 from neuraminidase__InfluenzaA__ACF22151

SEQ ID NO: 168946 - RNA, 1410 nt, Artificial Sequence; identical to SEQ ID NO: 166615
  derived and/or modified sequence opt4 from neuraminidase__InfluenzaA__ACF22246

SEQ ID NO: 168947 - RNA, 1410 nt, Artificial Sequence; identical to SEQ ID NO: 166615
  derived and/or modified sequence opt4 from neuraminidase__InfluenzaA__ACF22257

SEQ ID NO: 168948 - RNA, 1410 nt, Artificial Sequence; identical to SEQ ID NO: 166615
  derived and/or modified sequence opt4 from neuraminidase__InfluenzaA__ACF22279

SEQ ID NO: 168949 - RNA, 1410 nt, Artificial Sequence; identical to SEQ ID NO: 166615
  derived and/or modified sequence opt4 from neuraminidase__InfluenzaA__ACF22290

SEQ ID NO: 168950 - RNA, 1410 nt, Artificial Sequence; identical to SEQ ID NO: 166615
  derived and/or modified sequence opt4 from neuraminidase__InfluenzaA__ACF22301

SEQ ID NO: 168951 - RNA, 1410 nt, Artificial Sequence; identical to SEQ ID NO: 166615
  derived and/or modified sequence opt4 from neuraminidase__InfluenzaA__ACF22312

SEQ ID NO: 168952 - RNA, 1410 nt, Artificial Sequence
  derived and/or modified sequence opt4 from neuraminidase__InfluenzaA__ACF22323
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccuacgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168953 - RNA, 1410 nt, Artificial Sequence; identical to SEQ ID NO: 166615
  derived and/or modified sequence opt4 from neuraminidase__InfluenzaA__ACF22334

SEQ ID NO: 168954 - RNA, 1410 nt, Artificial Sequence; identical to SEQ ID NO: 166615
  derived and/or modified sequence opt4 from neuraminidase__InfluenzaA__ACF22367

SEQ ID NO: 168955 - RNA, 1410 nt, Artificial Sequence
  derived and/or modified sequence opt4 from neuraminidase__InfluenzaA__ACF22378
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcaagaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168956 - RNA, 1410 nt, Artificial Sequence
  derived and/or modified sequence opt4 from neuraminidase__InfluenzaA__ACF22389
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgugcccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168957 - RNA, 1410 nt, Artificial Sequence
  derived and/or modified sequence opt4 from neuraminidase__InfluenzaA__ACF22400
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugauggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168958 - RNA, 1410 nt, Artificial Sequence; identical to SEQ ID NO: 168586
  derived and/or modified sequence opt4 from neuraminidase__InfluenzaA__ACF22411

SEQ ID NO: 168959 - RNA, 1413 nt, Artificial Sequence
  derived and/or modified sequence opt4 from neuraminidase__InfluenzaA__ACF33772
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggccggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuucuacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaucgccaacuggagcuggcccgacggcgccgagcugcccuucaccaucgacaaguga

SEQ ID NO: 168960 - RNA, 1410 nt, Artificial Sequence
  derived and/or modified sequence opt4 from neuraminidase__InfluenzaA__ACF33778
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcauccccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagaacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168961 - RNA, 1410 nt, Artificial Sequence
  derived and/or modified sequence opt4 from neuraminidase__InfluenzaA__ACF33785
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgugagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168962 - RNA, 1413 nt, Artificial Sequence
  derived and/or modified sequence opt4 from neuraminidase__InfluenzaA__ACF33787
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggccggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccggcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcggcaucgccaacuggagcuggcccgacggcgccgagcugcccuucaccaucgacaaguga

SEQ ID NO: 168963 - RNA, 1410 nt, Artificial Sequence; identical to SEQ ID NO: 168404
  derived and/or modified sequence opt4 from neuraminidase__InfluenzaA__ACF33798

SEQ ID NO: 168964 - RNA, 1410 nt, Artificial Sequence; identical to SEQ ID NO: 168577
  derived and/or modified sequence opt4 from neuraminidase__InfluenzaA__ACF41672

SEQ ID NO: 168965 - RNA, 1413 nt, Artificial Sequence; identical to SEQ ID NO: 168550
  derived and/or modified sequence opt4 from neuraminidase__InfluenzaA__ACF41683

SEQ ID NO: 168966 - RNA, 1410 nt, Artificial Sequence
  derived and/or modified sequence opt4 from neuraminidase__InfluenzaA__ACF41749
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccggcaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168967 - RNA, 1410 nt, Artificial Sequence
  derived and/or modified sequence opt4 from neuraminidase__InfluenzaA__ACF41760
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgacagaggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168968 - RNA, 1410 nt, Artificial Sequence
  derived and/or modified sequence opt4 from neuraminidase__InfluenzaA__ACF41771
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaucaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168969 - RNA, 1410 nt, Artificial Sequence; identical to SEQ ID NO: 166615
  derived and/or modified sequence opt4 from neuraminidase__InfluenzaA__ACF41793

SEQ ID NO: 168970 - RNA, 1410 nt, Artificial Sequence; identical to SEQ ID NO: 166615
  derived and/or modified sequence opt4 from neuraminidase__InfluenzaA__ACF41804

SEQ ID NO: 168971 - RNA, 1410 nt, Artificial Sequence; identical to SEQ ID NO: 166615
  derived and/or modified sequence opt4 from neuraminidase__InfluenzaA__ACF41826

SEQ ID NO: 168972 - RNA, 1365 nt, Artificial Sequence; identical to SEQ ID NO: 168239
  derived and/or modified sequence opt4 from neuraminidase__InfluenzaA__ACF41837

SEQ ID NO: 168973 - RNA, 1413 nt, Artificial Sequence
  derived and/or modified sequence opt4 from neuraminidase__InfluenzaA__ACF41881
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168974 - RNA, 1410 nt, Artificial Sequence; identical to SEQ ID NO: 168449
  derived and/or modified sequence opt4 from neuraminidase__InfluenzaA__ACF41892

SEQ ID NO: 168975 - RNA, 1410 nt, Artificial Sequence; identical to SEQ ID NO: 166847
  derived and/or modified sequence opt4 from neuraminidase__InfluenzaA__ACF41903

SEQ ID NO: 168976 - RNA, 1410 nt, Artificial Sequence
  derived and/or modified sequence opt4 from neuraminidase__InfluenzaA__ACF41914
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccugggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168977 - RNA, 1413 nt, Artificial Sequence
  derived and/or modified sequence opt4 from neuraminidase__InfluenzaA__ACF41925
augaaccccaaccagaagaucaucaccaucggcagcaucagcauggccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacagaaucuucaagaucgagaagggcaaggugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcgugaagcaggacgugguggccaugaccgacuggagcggcuacagcggcagcuucgugcagcaccccgagcugaccggccuggacugcaugagacccugcuucuggguggagcugaucagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168978 - RNA, 1413 nt, Artificial Sequence; identical to SEQ ID NO: 168977
  derived and/or modified sequence opt4 from neuraminidase__InfluenzaA__ACF41936

SEQ ID NO: 168979 - RNA, 1410 nt, Artificial Sequence
  derived and/or modified sequence opt4 from neuraminidase__InfluenzaA__ACF54392
augaaccccaaccagaagaucaucaccaucggcagcgugagccugaccaccgccaccgccugcuuccugacccagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgacagcggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagauucagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168980 - RNA, 1410 nt, Artificial Sequence; identical to SEQ ID NO: 166615
  derived and/or modified sequence opt4 from neuraminidase__InfluenzaA__ACF54403

SEQ ID NO: 168981 - RNA, 1410 nt, Artificial Sequence; identical to SEQ ID NO: 166615
  derived and/or modified sequence opt4 from neuraminidase__InfluenzaA__ACF54414

SEQ ID NO: 168982 - RNA, 1410 nt, Artificial Sequence; identical to SEQ ID NO: 166615
  derived and/or modified sequence opt4 from neuraminidase__InfluenzaA__ACF54425

SEQ ID NO: 168983 - RNA, 1410 nt, Artificial Sequence; identical to SEQ ID NO: 166615
  derived and/or modified sequence opt4 from neuraminidase__InfluenzaA__ACF54436

SEQ ID NO: 168984 - RNA, 1410 nt, Artificial Sequence
  derived and/or modified sequence opt4 from neuraminidase__InfluenzaA__ACF54447
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168985 - RNA, 1410 nt, Artificial Sequence
  derived and/or modified sequence opt4 from neuraminidase__InfluenzaA__ACF54469
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcauggccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168986 - RNA, 1410 nt, Artificial Sequence; identical to SEQ ID NO: 168280
  derived and/or modified sequence opt4 from neuraminidase__InfluenzaA__ACF54480

SEQ ID NO: 168987 - RNA, 1410 nt, Artificial Sequence
  derived and/or modified sequence opt4 from neuraminidase__InfluenzaA__ACF54502
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugagcuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168988 - RNA, 1410 nt, Artificial Sequence; identical to SEQ ID NO: 168987
  derived and/or modified sequence opt4 from neuraminidase__InfluenzaA__ACF54513

SEQ ID NO: 168989 - RNA, 1410 nt, Artificial Sequence
  derived and/or modified sequence opt4 from neuraminidase__InfluenzaA__ACF54524
augaaccccaaccagaagaucaucaccaucggcagcgugagccugaccaucgccaccgugugcuucuucaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugagcuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168990 - RNA, 1410 nt, Artificial Sequence
  derived and/or modified sequence opt4 from neuraminidase__InfluenzaA__ACF54535
augaaccccaaccagaagaucaucaccaucggcagcgugagccugaucaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccaagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168991 - RNA, 1410 nt, Artificial Sequence; identical to SEQ ID NO: 166804
  derived and/or modified sequence opt4 from neuraminidase__InfluenzaA__ACF54557

SEQ ID NO: 168992 - RNA, 1410 nt, Artificial Sequence; identical to SEQ ID NO: 168449
  derived and/or modified sequence opt4 from neuraminidase__InfluenzaA__ACF54568

SEQ ID NO: 168993 - RNA, 1410 nt, Artificial Sequence
  derived and/or modified sequence opt4 from neuraminidase__InfluenzaA__ACF54579
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaucaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168994 - RNA, 1362 nt, Artificial Sequence
  derived and/or modified sequence opt4 from neuraminidase__InfluenzaA__ACF54601
augaaccccaaccagaagaucaucaccaucggcagcaucugcaugguggugggcaucaucagccugauccugcagaucggcaacaucaucagcaucuggaucagccacagcauccagaccggcaaccagaaccacaccggcaucugcaaccagggcagcaucaccuacaaggugguggccggccaggacagcaccagcgugauccugaccggcaacagcagccugugccccaucagaggcugggccauccacagcaaggacaacggcaucagaaucggcagcaagggcgacguguucgugaucagagagcccuucaucagcugcagccaccuggagugcagaaccuucuuccugacccagggcgcccugcugaacgacaagcacagcagaggcaccuucaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagaacauccugagaacccaggagagcgagugcaccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuacaagaucggcuacaucugcagcggcguguucggcgacaaccccagacccaaggacggcaccggcagcugcggccccgugagcgccgacggcgccaacggcgugaagggcuucagcuacaaguacggcaacggcguguggaucggcagaaccaagagcgacagcagcagacacggcuucgagaugaucugggaccccaacggcuggaccgagaccgacagcagauucagcaugagacaggacgugguggccaugaccgacagaagcggcuacagcggcagcuucgugcagcaccccgagcugaccggccuggacugcaugagacccugcuucuggguggagcugaucagaggccugcccgaggagaacgccaucuggaccagcggcagcaucaucagcuucugcggcgugaacagcgacaccguggacuggagcuggcccgacggcgccgagcugcccuucaccaucgacaaguga

SEQ ID NO: 168995 - RNA, 1350 nt, Artificial Sequence
  derived and/or modified sequence opt4 from neuraminidase__InfluenzaA__ACG50700
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagcaacaccaacuuccugaccgagaaggccguggccagcgugacccuggccggcaacagcccccugugccccaucagcggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccagcgaggugaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcaccaacggcgccuacggcgugaagggcuucagcuucaaguacggcaacggcguguggaucggcagaaccaagagcaccaacagcagaagcggcuucgagaugaucugggacagcaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 168996 - RNA, 1410 nt, Artificial Sequence; identical to SEQ ID NO: 168577
  derived and/or modified sequence opt4 from neuraminidase__InfluenzaA__ACG70145

SEQ ID NO: 168997 - RNA, 1410 nt, Artificial Sequence; identical to SEQ ID NO: 168404
  derived and/or modified sequence opt4 from neuraminidase__InfluenzaA__ACG70156

SEQ ID NO: 168998 - RNA, 1410 nt, Artificial Sequence
  derived and/or modified sequence opt4 from neuraminidase__InfluenzaA__ACG80407
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcuggccaaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgccagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168999 - RNA, 1410 nt, Artificial Sequence
  derived and/or modified sequence opt4 from neuraminidase__InfluenzaA__ACG80411
auggacagcaacagcaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgccggcggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacgacggcagacugguggacggcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169000 - RNA, 1407 nt, Artificial Sequence
  derived and/or modified sequence opt4 from neuraminidase__InfluenzaA__ACG80421
augaaccccauccagaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcgacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169001 - RNA, 1407 nt, Artificial Sequence
  derived and/or modified sequence opt4 from neuraminidase__InfluenzaA__ACG80427
auggaccccaacagcaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcgacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169002 - RNA, 1410 nt, Artificial Sequence
  derived and/or modified sequence opt4 from neuraminidase__InfluenzaA__ACG80437
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccaacuucaucuacaacggcagacugguggacagcaucgugagcuggagcaaggagaucuucagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169003 - RNA, 1407 nt, Artificial Sequence
  derived and/or modified sequence opt4 from neuraminidase__InfluenzaA__ACG80446
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcgacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169004 - RNA, 1410 nt, Artificial Sequence
  derived and/or modified sequence opt4 from neuraminidase__InfluenzaA__ACG80455
augaaccccaaccagaagaucaucaccaucggcagcgugagcuucaucaucagcagcaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgccagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacgacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169005 - RNA, 1407 nt, Artificial Sequence; identical to SEQ ID NO: 169003
  derived and/or modified sequence opt4 from neuraminidase__InfluenzaA__ACG80464

SEQ ID NO: 169006 - RNA, 1410 nt, Artificial Sequence
  derived and/or modified sequence opt4 from neuraminidase__InfluenzaA__ACG80473
auggaccccauccagaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgccagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacgacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169007 - RNA, 1410 nt, Artificial Sequence; identical to SEQ ID NO: 167232
  derived and/or modified sequence opt4 from neuraminidase__InfluenzaA__ACH69559

SEQ ID NO: 169008 - RNA, 1410 nt, Artificial Sequence
  derived and/or modified sequence opt4 from neuraminidase__InfluenzaA__ACH69570
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaacaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169009 - RNA, 1410 nt, Artificial Sequence; identical to SEQ ID NO: 167232
  derived and/or modified sequence opt4 from neuraminidase__InfluenzaA__ACH69581

SEQ ID NO: 169010 - RNA, 1410 nt, Artificial Sequence
  derived and/or modified sequence opt4 from neuraminidase__InfluenzaA__ACH69592
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaaccagugcuucuacguggagcugaucagaggcagaaagcaggagaccgaggugcuguggaccagcaacagcaucgugguguucugcggcaccagcggcaccuacggcaccggcagcuggcccgacggcgccgaccugaaccugaugcccaucuga

SEQ ID NO: 169011 - RNA, 1410 nt, Artificial Sequence
  derived and/or modified sequence opt4 from neuraminidase__InfluenzaA__ACH69603
augaaccccaaccagaagaucaucaccaucggcagcgugagccugaccaucgccaccaucugcuuccugaugcagaucgugauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgaccugaaccugaugcccaucuga

SEQ ID NO: 169012 - RNA, 1410 nt, Artificial Sequence
  derived and/or modified sequence opt4 from neuraminidase__InfluenzaA__ACH69614
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgaccugaaccugaugcccaucuga

SEQ ID NO: 169013 - RNA, 1413 nt, Artificial Sequence
  derived and/or modified sequence opt4 from neuraminidase__InfluenzaA__ACI22525
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169014 - RNA, 1413 nt, Artificial Sequence; identical to SEQ ID NO: 169013
  derived and/or modified sequence opt4 from neuraminidase__InfluenzaA__ACI22526

SEQ ID NO: 169015 - RNA, 1413 nt, Artificial Sequence; identical to SEQ ID NO: 169013
  derived and/or modified sequence opt4 from neuraminidase__InfluenzaA__ACI22527

SEQ ID NO: 169016 - RNA, 1413 nt, Artificial Sequence; identical to SEQ ID NO: 169013
  derived and/or modified sequence opt4 from neuraminidase__InfluenzaA__ACI22528

SEQ ID NO: 169017 - RNA, 1413 nt, Artificial Sequence; identical to SEQ ID NO: 169013
  derived and/or modified sequence opt4 from neuraminidase__InfluenzaA__ACI22529

SEQ ID NO: 169018 - RNA, 1413 nt, Artificial Sequence; identical to SEQ ID NO: 169013
  derived and/or modified sequence opt4 from neuraminidase__InfluenzaA__ACI22530

SEQ ID NO: 169019 - RNA, 1413 nt, Artificial Sequence
  derived and/or modified sequence opt4 from neuraminidase__InfluenzaA__ACI22532
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169020 - RNA, 1413 nt, Artificial Sequence; identical to SEQ ID NO: 169019
  derived and/or modified sequence opt4 from neuraminidase__InfluenzaA__ACI22533

SEQ ID NO: 169021 - RNA, 1413 nt, Artificial Sequence; identical to SEQ ID NO: 169013
  derived and/or modified sequence opt4 from neuraminidase__InfluenzaA__ACI22534

SEQ ID NO: 169022 - RNA, 1410 nt, Artificial Sequence
  derived and/or modified sequence opt4 from neuraminidase__InfluenzaA__ACI25727
augaaccccaaccagaagaucaucaccaucggcagcgugagccugaccaucgccaccgugugcuuccugaugcagaucgccauccuggugaccaccgugacccugcacuucaagcagcacgagugcaacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 169023 - RNA, 1410 nt, Artificial Sequence
  derived and/or modified sequence opt4 from neuraminidase__InfluenzaA__ACI25749
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcacaucuga

SEQ ID NO: 169024 - RNA, 1410 nt, Artificial Sequence; identical to SEQ ID NO: 169023
  derived and/or modified sequence opt4 from neuraminidase__InfluenzaA__ACI25760

SEQ ID NO: 169025 - RNA, 1410 nt, Artificial Sequence; identical to SEQ ID NO: 169023
  derived and/or modified sequence opt4 from neuraminidase__InfluenzaA__ACI25771

SEQ ID NO: 169026 - RNA, 1410 nt, Artificial Sequence; identical to SEQ ID NO: 166615
  derived and/or modified sequence opt4 from neuraminidase__InfluenzaA__ACI25782

SEQ ID NO: 169027 - RNA, 1410 nt, Artificial Sequence
  derived and/or modified sequence opt4 from neuraminidase__InfluenzaA__ACI25793
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgugggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 169028 - RNA, 1410 nt, Artificial Sequence
  derived and/or modified sequence opt4 from neuraminidase__InfluenzaA__ACI25804
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgaccacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 169029 - RNA, 1410 nt, Artificial Sequence; identical to SEQ ID NO: 168987
  derived and/or modified sequence opt4 from neuraminidase__InfluenzaA__ACI26277

SEQ ID NO: 169030 - RNA, 1410 nt, Artificial Sequence; identical to SEQ ID NO: 166847
  derived and/or modified sequence opt4 from neuraminidase__InfluenzaA__ACI26299

SEQ ID NO: 169031 - RNA, 1410 nt, Artificial Sequence
  derived and/or modified sequence opt4 from neuraminidase__InfluenzaA__ACI26321
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaccgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169032 - RNA, 1410 nt, Artificial Sequence
  derived and/or modified sequence opt4 from neuraminidase__InfluenzaA__ACI26354
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169033 - RNA, 1410 nt, Artificial Sequence
  derived and/or modified sequence opt4 from neuraminidase__InfluenzaA__ACI26365
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugaccggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcgugcacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169034 - RNA, 1410 nt, Artificial Sequence; identical to SEQ ID NO: 169032
  derived and/or modified sequence opt4 from neuraminidase__InfluenzaA__ACI26376

SEQ ID NO: 169035 - RNA, 1410 nt, Artificial Sequence; identical to SEQ ID NO: 168924
  derived and/or modified sequence opt4 from neuraminidase__InfluenzaA__ACI26387

SEQ ID NO: 169036 - RNA, 1410 nt, Artificial Sequence; identical to SEQ ID NO: 168936
  derived and/or modified sequence opt4 from neuraminidase__InfluenzaA__ACI26420

SEQ ID NO: 169037 - RNA, 1410 nt, Artificial Sequence; identical to SEQ ID NO: 166847
  derived and/or modified sequence opt4 from neuraminidase__InfluenzaA__ACI26431

SEQ ID NO: 169038 - RNA, 1413 nt, Artificial Sequence
  derived and/or modified sequence opt4 from neuraminidase__InfluenzaA__ACI26442
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccaucgacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169039 - RNA, 1413 nt, Artificial Sequence; identical to SEQ ID NO: 169038
  derived and/or modified sequence opt4 from neuraminidase__InfluenzaA__ACI26453

SEQ ID NO: 169040 - RNA, 1410 nt, Artificial Sequence
  derived and/or modified sequence opt4 from neuraminidase__InfluenzaA__ACI26464
augaaccccaaccagaagaucaucaccaucggcagcgugagccugaccaucagcaccaucugcuucuucaugcagaucgccauccugaucgccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaccgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169041 - RNA, 1410 nt, Artificial Sequence; identical to SEQ ID NO: 169031
  derived and/or modified sequence opt4 from neuraminidase__InfluenzaA__ACI26475

SEQ ID NO: 169042 - RNA, 1410 nt, Artificial Sequence; identical to SEQ ID NO: 169032
  derived and/or modified sequence opt4 from neuraminidase__InfluenzaA__ACI26486

SEQ ID NO: 169043 - RNA, 1410 nt, Artificial Sequence; identical to SEQ ID NO: 169032
  derived and/or modified sequence opt4 from neuraminidase__InfluenzaA__ACI26497

SEQ ID NO: 169044 - RNA, 1410 nt, Artificial Sequence; identical to SEQ ID NO: 169032
  derived and/or modified sequence opt4 from neuraminidase__InfluenzaA__ACI26508

SEQ ID NO: 169045 - RNA, 1410 nt, Artificial Sequence
  derived and/or modified sequence opt4 from neuraminidase__InfluenzaA__ACI26519
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 169046 - RNA, 1410 nt, Artificial Sequence; identical to SEQ ID NO: 169032
  derived and/or modified sequence opt4 from neuraminidase__InfluenzaA__ACI26530

SEQ ID NO: 169047 - RNA, 1410 nt, Artificial Sequence; identical to SEQ ID NO: 169032
  derived and/or modified sequence opt4 from neuraminidase__InfluenzaA__ACI26541

SEQ ID NO: 169048 - RNA, 1410 nt, Artificial Sequence
  derived and/or modified sequence opt4 from neuraminidase__InfluenzaA__ACI26552
augaaccccaaccagaagaucaucaccaucggcagcgugagccugaccaucgccaccaugugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 169049 - RNA, 1410 nt, Artificial Sequence
  derived and/or modified sequence opt4 from neuraminidase__InfluenzaA__ACI26574
augaaccccaaccagaagaucaucaccaucggcagcgugagccugacccuggccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaucaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccugaacaacagacacagcaacgacaccgugcacgacagaacccccuacagaacccugcugaugaacgagcugggcgugcccuuccaccugggcaccagacaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 169050 - RNA, 1410 nt, Artificial Sequence
  derived and/or modified sequence opt4 from neuraminidase__InfluenzaA__ACI26585
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucgugagcuggagcaagaacgugcugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaccaacagacaggugaucguggacagaggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 169051 - RNA, 1413 nt, Artificial Sequence
  derived and/or modified sequence opt4 from neuraminidase__InfluenzaA__ACI32764
augaaccccaaccagaagaucaucaccaucggcagcaucagcauggccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 169052 - RNA, 1413 nt, Artificial Sequence
  derived and/or modified sequence opt4 from neuraminidase__InfluenzaA__ACI32765
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacaacaccugggugaaccacaccuacgugaacaucaacaacaccaacgugguggccagaaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuucaugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 169053 - RNA, 1413 nt, Artificial Sequence; identical to SEQ ID NO: 166906
  derived and/or modified sequence opt4 from neuraminidase__InfluenzaA__ACI32766

SEQ ID NO: 169054 - RNA, 1413 nt, Artificial Sequence
  derived and/or modified sequence opt4 from neuraminidase__InfluenzaA__ACI32767
augaaccccaaccagaagaucaucaccaucggcagcaucagcaucgccaucggcaucaucagccugaugcugcagaucggcaacaucaucagcaucugggccagccacagcacccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcgugagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 169055 - RNA, 1413 nt, Artificial Sequence
  derived and/or modified sequence opt4 from neuraminidase__InfluenzaA__ACI32768
augaaccccaaccagaagaucaucaccaucggcagcaucagcaucgccaucggcaucaucagccugaugagccagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 169056 - RNA, 1413 nt, Artificial Sequence
  derived and/or modified sequence opt4 from neuraminidase__InfluenzaA__ACI32769
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaucagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 169057 - RNA, 1413 nt, Artificial Sequence; identical to SEQ ID NO: 166906
  derived and/or modified sequence opt4 from neuraminidase__InfluenzaA__ACI32770

SEQ ID NO: 169058 - RNA, 1413 nt, Artificial Sequence
  derived and/or modified sequence opt4 from neuraminidase__InfluenzaA__ACI32771
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacaagaacagcaccugggugaaccacaccuacgugaacaucaacaacaccaacgugguggccggcaagggcaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 169059 - RNA, 1413 nt, Artificial Sequence; identical to SEQ ID NO: 166906
  derived and/or modified sequence opt4 from neuraminidase__InfluenzaA__ACI32772

SEQ ID NO: 169060 - RNA, 1413 nt, Artificial Sequence; identical to SEQ ID NO: 166906
  derived and/or modified sequence opt4 from neuraminidase__InfluenzaA__ACI32773

SEQ ID NO: 169061 - RNA, 1413 nt, Artificial Sequence; identical to SEQ ID NO: 166906
  derived and/or modified sequence opt4 from neuraminidase__InfluenzaA__ACI32774

SEQ ID NO: 169062 - RNA, 1413 nt, Artificial Sequence; identical to SEQ ID NO: 166906
  derived and/or modified sequence opt4 from neuraminidase__InfluenzaA__ACI32775

SEQ ID NO: 169063 - RNA, 1413 nt, Artificial Sequence
  derived and/or modified sequence opt4 from neuraminidase__InfluenzaA__ACI32776
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacaagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 169064 - RNA, 1413 nt, Artificial Sequence
  derived and/or modified sequence opt4 from neuraminidase__InfluenzaA__ACI32777
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacaagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucgccaucgacaaguga

SEQ ID NO: 169065 - RNA, 1413 nt, Artificial Sequence; identical to SEQ ID NO: 166906
  derived and/or modified sequence opt4 from neuraminidase__InfluenzaA__ACI32778

SEQ ID NO: 169066 - RNA, 1413 nt, Artificial Sequence; identical to SEQ ID NO: 166906
  derived and/or modified sequence opt4 from neuraminidase__InfluenzaA__ACI32779

SEQ ID NO: 169067 - RNA, 1413 nt, Artificial Sequence; identical to SEQ ID NO: 166906
  derived and/or modified sequence opt4 from neuraminidase__InfluenzaA__ACI32780

SEQ ID NO: 169068 - RNA, 1413 nt, Artificial Sequence; identical to SEQ ID NO: 166906
  derived and/or modified sequence opt4 from neuraminidase__InfluenzaA__ACI32781

SEQ ID NO: 169069 - RNA, 1413 nt, Artificial Sequence
  derived and/or modified sequence opt4 from neuraminidase__InfluenzaA__ACI32782
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggccaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagaaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169070 - RNA, 1413 nt, Artificial Sequence
  derived and/or modified sequence opt4 from neuraminidase__InfluenzaA__ACI32783
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccuggcugagcuucaaccagaaccuggacuaccagaucggcuacaucugcagcggcgugaucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacggcgacaccgccaacuggagcuggcccgacggcgccgagcugcccuucaccaucgacaaguga

SEQ ID NO: 169071 - RNA, 1413 nt, Artificial Sequence
  derived and/or modified sequence opt4 from neuraminidase__InfluenzaA__ACI32784
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggccaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169072 - RNA, 1413 nt, Artificial Sequence
  derived and/or modified sequence opt4 from neuraminidase__InfluenzaA__ACI32785
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaugugcaaccagagaaucaucaccuacgagaacagcaccugggugaaccacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcugggccgacaccgacagcgacuucagcgugaagcaggacgugguggccaucaccgacuggagcggcuacagcggcagcuucgugcagcaccccgagcugaccggccugaacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 169073 - RNA, 1413 nt, Artificial Sequence
  derived and/or modified sequence opt4 from neuraminidase__InfluenzaA__ACI32787
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcggcaccgccgacuggagcuggcccgacggcgccgagcugcccuucaccaucgacaaguga

SEQ ID NO: 169074 - RNA, 1413 nt, Artificial Sequence
  derived and/or modified sequence opt4 from neuraminidase__InfluenzaA__ACI32788
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaccugcaaccagagaaucaucaccuacgagaacaacaccugggugaaccacaccugcgugaacaucaacaacaccaacgugguggccggcaaggacaagaccagcgugacccuggugggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaagggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 169075 - RNA, 1410 nt, Artificial Sequence
  derived and/or modified sequence opt4 from neuraminidase__InfluenzaA__ACI32790
augaaccccaaccagaagaucaucaccaucggcagcgugagccugaccaucgccaccaucugcuuccugacccagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 169076 - RNA, 1410 nt, Artificial Sequence; identical to SEQ ID NO: 166902
  derived and/or modified sequence opt4 from neuraminidase__InfluenzaA__ACI32791

SEQ ID NO: 169077 - RNA, 1410 nt, Artificial Sequence; identical to SEQ ID NO: 166902
  derived and/or modified sequence opt4 from neuraminidase__InfluenzaA__ACI32793

SEQ ID NO: 169078 - RNA, 1410 nt, Artificial Sequence; identical to SEQ ID NO: 166902
  derived and/or modified sequence opt4 from neuraminidase__InfluenzaA__ACI32794

SEQ ID NO: 169079 - RNA, 1410 nt, Artificial Sequence; identical to SEQ ID NO: 167232
  derived and/or modified sequence opt4 from neuraminidase__InfluenzaA__ACI32795

SEQ ID NO: 169080 - RNA, 1410 nt, Artificial Sequence
  derived and/or modified sequence opt4 from neuraminidase__InfluenzaA__ACI32796
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcagcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169081 - RNA, 1410 nt, Artificial Sequence
  derived and/or modified sequence opt4 from neuraminidase__InfluenzaA__ACI32797
augaaccccaaccagaugaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcagcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169082 - RNA, 1410 nt, Artificial Sequence
  derived and/or modified sequence opt4 from neuraminidase__InfluenzaA__ACI32798
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaacgagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169083 - RNA, 1410 nt, Artificial Sequence
  derived and/or modified sequence opt4 from neuraminidase__InfluenzaA__ACI32799
augaaccccaaccagagaaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccaacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169084 - RNA, 1410 nt, Artificial Sequence
  derived and/or modified sequence opt4 from neuraminidase__InfluenzaA__ACI32800
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169085 - RNA, 1410 nt, Artificial Sequence; identical to SEQ ID NO: 169084
  derived and/or modified sequence opt4 from neuraminidase__InfluenzaA__ACI32802

SEQ ID NO: 169086 - RNA, 1410 nt, Artificial Sequence; identical to SEQ ID NO: 169084
  derived and/or modified sequence opt4 from neuraminidase__InfluenzaA__ACI32803

SEQ ID NO: 169087 - RNA, 1410 nt, Artificial Sequence; identical to SEQ ID NO: 168227
  derived and/or modified sequence opt4 from neuraminidase__InfluenzaA__ACI32804

SEQ ID NO: 169088 - RNA, 1410 nt, Artificial Sequence
  derived and/or modified sequence opt4 from neuraminidase__InfluenzaA__ACI32805
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgugaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagaagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169089 - RNA, 1410 nt, Artificial Sequence; identical to SEQ ID NO: 167232
  derived and/or modified sequence opt4 from neuraminidase__InfluenzaA__ACI32806

SEQ ID NO: 169090 - RNA, 1410 nt, Artificial Sequence
  derived and/or modified sequence opt4 from neuraminidase__InfluenzaA__ACI32807
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggaggugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169091 - RNA, 1410 nt, Artificial Sequence
  derived and/or modified sequence opt4 from neuraminidase__InfluenzaA__ACI32808
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggagaagaccgaggugcuguggaccagcaacagcaucgugguguucugcggcaccagcggcaccuacggcaccggcagcuggcccgacggcgccgacaucaaccugaugcccaucuga

SEQ ID NO: 169092 - RNA, 1410 nt, Artificial Sequence; identical to SEQ ID NO: 168227
  derived and/or modified sequence opt4 from neuraminidase__InfluenzaA__ACI32809

SEQ ID NO: 169093 - RNA, 1410 nt, Artificial Sequence
  derived and/or modified sequence opt4 from neuraminidase__InfluenzaA__ACI32810
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaaccccccacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169094 - RNA, 1410 nt, Artificial Sequence
  derived and/or modified sequence opt4 from neuraminidase__InfluenzaA__ACI32811
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169095 - RNA, 1410 nt, Artificial Sequence
  derived and/or modified sequence opt4 from neuraminidase__InfluenzaA__ACI32812
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccaacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169096 - RNA, 1410 nt, Artificial Sequence; identical to SEQ ID NO: 167319
  derived and/or modified sequence opt4 from neuraminidase__InfluenzaA__ACI32814

SEQ ID NO: 169097 - RNA, 1350 nt, Artificial Sequence
  derived and/or modified sequence opt4 from neuraminidase__InfluenzaA__ACJ53848
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 169098 - RNA, 1350 nt, Artificial Sequence
  derived and/or modified sequence opt4 from neuraminidase__InfluenzaA__ACJ53849
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcagccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 169099 - RNA, 1350 nt, Artificial Sequence
  derived and/or modified sequence opt4 from neuraminidase__InfluenzaA__ACJ53853
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 169100 - RNA, 1350 nt, Artificial Sequence; identical to SEQ ID NO: 169099
  derived and/or modified sequence opt4 from neuraminidase__InfluenzaA__ACJ53866

SEQ ID NO: 169101 - RNA, 1350 nt, Artificial Sequence
  derived and/or modified sequence opt4 from neuraminidase__InfluenzaA__ACJ53867
augaaccccaaccagaagaucaucaccaucggcagcaucugcauggccaucggcaucgugagccugaugcugcagaucggcaacaugaucagccugugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 169102 - RNA, 1350 nt, Artificial Sequence
  derived and/or modified sequence opt4 from neuraminidase__InfluenzaA__ACJ53875
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggaggcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 169103 - RNA, 1350 nt, Artificial Sequence
  derived and/or modified sequence opt4 from neuraminidase__InfluenzaA__ACJ53876
augaaccccaaccagaagaucaucaccaucggcagcaucugcauggugaucggcaucgugagccugaugcugcagaucggcaacaucaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 169104 - RNA, 1404 nt, Artificial Sequence
  derived and/or modified sequence opt4 from neuraminidase__InfluenzaA__ACJ67535
augaaccccaaccagaagaucaucgcccugggcagcgugagcaucaccaucgccaccaucugccugaucaugcagaucgccgugcuggccaccaccaugacccugcacuucaacgagugcaccaaccccagcaacaaccaggccaugcccugcgagcccaucaucaucgagagaaacaugaccgagaucgugcaccugaacaacaccaccaucgagaaggagagcugccccaagguggccgaguacaagaacuggagcaagccccagugccagaucaccggcuucgcccccuucagcaaggacaacagcaucagacugagcgccggcggcgacaucugggugaccagagagcccuacgugagcugcggccugggcaacugcuaccaguucgcccugggccagggcaccacccugaacaacaagcacagcaacgacaccauccacgacagaagcccccacagaacccugcugaugaacgagcugggcgugcccuuccaccugggcaccaagcaggugugcaucgccuggagcagcagcagcugccacgacggcaaggccuggcugcacgugugcgugaccggcgacgacagaaacgccaccgccagcaucaucuacgacggcaugcugaccgacagcaucggcagcuggagcaagaacauccugagaacccaggagagcgagugcgugugcaucaacggcaccugcaccguggugaugaccgacggcagcgccagcggcagagccgacaccaagauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguacaucaacguggccgacuacagcguggacagcagcuacgugugcagcggccuggugggcgacacccccagaaacgacgacagcagcagcagcagcaacugcagagaccccaacaacgagagaggcggccccggcgugaagggcugggccuucgacaacggcaacgacguguggaugggcagaaccaucaagaaggacagcagaagcggcuacgagaccuucagaguggugggcggcuggaccaccgccaacagcaagagccagaucaacagacaggugaucguggacagcgacaacuggagcggcuacagcggcaucuucagcguggagggcaagaccugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugagcaucuga

SEQ ID NO: 169105 - RNA, 1410 nt, Artificial Sequence
  derived and/or modified sequence opt4 from neuraminidase__InfluenzaA__ACK99424
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugauccccugccagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagguggugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 169106 - RNA, 1410 nt, Artificial Sequence; identical to SEQ ID NO: 168925
  derived and/or modified sequence opt4 from neuraminidase__InfluenzaA__ACK99435

SEQ ID NO: 169107 - RNA, 1413 nt, Artificial Sequence
  derived and/or modified sequence opt4 from neuraminidase__InfluenzaA__ACK99446
augaaccccaaccagaagaucaucaccaucggcagcaucagcauggccaucggcaucaucagccugacccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagagcccugaugagcugcccccugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacagaaucuucaagaucgagaagggcaaggugaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacagauacggcaacggcguguggaucggcagaaccaagagcaacagauucagaaagggcuucgagaugaucugggaccccaacggcuggaccgacaccgacagcgacuucagcgugaagcaggacgugguggccaugaccgacuggagcggcuacagcggcagcuucgugcagcaccccgagcugaccggccuggacugcaugagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169108 - RNA, 1410 nt, Artificial Sequence
  derived and/or modified sequence opt4 from neuraminidase__InfluenzaA__ACK99457
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucgugagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaccaacagacaggugaucguggacagaggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 169109 - RNA, 1413 nt, Artificial Sequence
  derived and/or modified sequence opt4 from neuraminidase__InfluenzaA__ACK99468
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacagcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169110 - RNA, 1410 nt, Artificial Sequence
  derived and/or modified sequence opt4 from neuraminidase__InfluenzaA__ACK99479
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccaacaucaaccugaugcccaucuga

SEQ ID NO: 169111 - RNA, 1413 nt, Artificial Sequence; identical to SEQ ID NO: 168804
  derived and/or modified sequence opt4 from neuraminidase__InfluenzaA__ACL12066

SEQ ID NO: 169112 - RNA, 1410 nt, Artificial Sequence; identical to SEQ ID NO: 167705
  derived and/or modified sequence opt4 from neuraminidase__InfluenzaA__ACL12132

SEQ ID NO: 169113 - RNA, 1413 nt, Artificial Sequence; identical to SEQ ID NO: 169038
  derived and/or modified sequence opt4 from neuraminidase__InfluenzaA__ACL12154

SEQ ID NO: 169114 - RNA, 1410 nt, Artificial Sequence; identical to SEQ ID NO: 169032
  derived and/or modified sequence opt4 from neuraminidase__InfluenzaA__ACL12165

SEQ ID NO: 169115 - RNA, 1410 nt, Artificial Sequence; identical to SEQ ID NO: 169032
  derived and/or modified sequence opt4 from neuraminidase__InfluenzaA__ACL12176

SEQ ID NO: 169116 - RNA, 1410 nt, Artificial Sequence
  derived and/or modified sequence opt4 from neuraminidase__InfluenzaA__ACL12198
augaaccccaaccagaagaucaucaccaucggcagcgugagccugaccaucagcaccaucugcuucuucaugcagaucgccauccugaucaccaccgugacccugcacuucaagcaguacgaguucaacagcacccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169117 - RNA, 1410 nt, Artificial Sequence; identical to SEQ ID NO: 168610
  derived and/or modified sequence opt4 from neuraminidase__InfluenzaA__ACL12209

SEQ ID NO: 169118 - RNA, 1410 nt, Artificial Sequence; identical to SEQ ID NO: 169032
  derived and/or modified sequence opt4 from neuraminidase__InfluenzaA__ACL12220

SEQ ID NO: 169119 - RNA, 1410 nt, Artificial Sequence
  derived and/or modified sequence opt4 from neuraminidase__InfluenzaA__ACL12242
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169120 - RNA, 1413 nt, Artificial Sequence
  derived and/or modified sequence opt4 from neuraminidase__InfluenzaA__ACL12264
augaaccccaaccagaagaucaucaccaucggcagcaucagcauggccaucggcaucaucagccugauccugcagaucgugaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacagaaucuucaagaucgagaagggcaaggugaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagauucagaaagggcuucgagaugaucugggaccccaacggcuggaccgacaccgacagcgacuucagcgugaagcaggacgugguggccaugaccgacuggagcggcuacagcggcagcuucgugcagcaccccgagcugaccggccuggacugcaugagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169121 - RNA, 1410 nt, Artificial Sequence; identical to SEQ ID NO: 168925
  derived and/or modified sequence opt4 from neuraminidase__InfluenzaA__ACN32275

SEQ ID NO: 169122 - RNA, 1410 nt, Artificial Sequence
  derived and/or modified sequence opt4 from neuraminidase__InfluenzaA__ACN32286
augaaccccaacaagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugcugggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169123 - RNA, 1410 nt, Artificial Sequence
  derived and/or modified sequence opt4 from neuraminidase__InfluenzaA__ACN32493
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169124 - RNA, 1410 nt, Artificial Sequence; identical to SEQ ID NO: 166674
  derived and/or modified sequence opt4 from neuraminidase__InfluenzaA__ACN32526

SEQ ID NO: 169125 - RNA, 1410 nt, Artificial Sequence
  derived and/or modified sequence opt4 from neuraminidase__InfluenzaA__ACN32537
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccgacgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgacggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 169126 - RNA, 1413 nt, Artificial Sequence; identical to SEQ ID NO: 168602
  derived and/or modified sequence opt4 from neuraminidase__InfluenzaA__ACN32807

SEQ ID NO: 169127 - RNA, 1413 nt, Artificial Sequence; identical to SEQ ID NO: 168550
  derived and/or modified sequence opt4 from neuraminidase__InfluenzaA__ACN32818

SEQ ID NO: 169128 - RNA, 1413 nt, Artificial Sequence; identical to SEQ ID NO: 168550
  derived and/or modified sequence opt4 from neuraminidase__InfluenzaA__ACN32829

SEQ ID NO: 169129 - RNA, 1413 nt, Artificial Sequence
  derived and/or modified sequence opt4 from neuraminidase__InfluenzaA__ACN32840
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgugaacuggagcuggcccgacggcgccgagcugcccuucaccaucgacaaguga

SEQ ID NO: 169130 - RNA, 1410 nt, Artificial Sequence; identical to SEQ ID NO: 169032
  derived and/or modified sequence opt4 from neuraminidase__InfluenzaA__ACN32851

SEQ ID NO: 169131 - RNA, 1410 nt, Artificial Sequence; identical to SEQ ID NO: 169119
  derived and/or modified sequence opt4 from neuraminidase__InfluenzaA__ACN32862

SEQ ID NO: 169132 - RNA, 1410 nt, Artificial Sequence; identical to SEQ ID NO: 169123
  derived and/or modified sequence opt4 from neuraminidase__InfluenzaA__ACN32873

SEQ ID NO: 169133 - RNA, 1410 nt, Artificial Sequence; identical to SEQ ID NO: 169119
  derived and/or modified sequence opt4 from neuraminidase__InfluenzaA__ACN32884

SEQ ID NO: 169134 - RNA, 1410 nt, Artificial Sequence; identical to SEQ ID NO: 169123
  derived and/or modified sequence opt4 from neuraminidase__InfluenzaA__ACN32895

SEQ ID NO: 169135 - RNA, 1410 nt, Artificial Sequence; identical to SEQ ID NO: 169032
  derived and/or modified sequence opt4 from neuraminidase__InfluenzaA__ACN32906

SEQ ID NO: 169136 - RNA, 1410 nt, Artificial Sequence
  derived and/or modified sequence opt4 from neuraminidase__InfluenzaA__ACN32917
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcaagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaccgaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169137 - RNA, 1410 nt, Artificial Sequence
  derived and/or modified sequence opt4 from neuraminidase__InfluenzaA__ACN32928
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaccgaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169138 - RNA, 1410 nt, Artificial Sequence; identical to SEQ ID NO: 169123
  derived and/or modified sequence opt4 from neuraminidase__InfluenzaA__ACN32939

SEQ ID NO: 169139 - RNA, 1410 nt, Artificial Sequence; identical to SEQ ID NO: 169032
  derived and/or modified sequence opt4 from neuraminidase__InfluenzaA__ACN32950

SEQ ID NO: 169140 - RNA, 1410 nt, Artificial Sequence
  derived and/or modified sequence opt4 from neuraminidase__InfluenzaA__ACN32961
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaccgaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaacaucaugcccaucuga

SEQ ID NO: 169141 - RNA, 1410 nt, Artificial Sequence; identical to SEQ ID NO: 169119
  derived and/or modified sequence opt4 from neuraminidase__InfluenzaA__ACN32972

SEQ ID NO: 169142 - RNA, 1410 nt, Artificial Sequence; identical to SEQ ID NO: 169119
  derived and/or modified sequence opt4 from neuraminidase__InfluenzaA__ACN32994

SEQ ID NO: 169143 - RNA, 1410 nt, Artificial Sequence
  derived and/or modified sequence opt4 from neuraminidase__InfluenzaA__ACN33005
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcgagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169144 - RNA, 1410 nt, Artificial Sequence; identical to SEQ ID NO: 169119
  derived and/or modified sequence opt4 from neuraminidase__InfluenzaA__ACN33016

SEQ ID NO: 169145 - RNA, 1410 nt, Artificial Sequence; identical to SEQ ID NO: 169119
  derived and/or modified sequence opt4 from neuraminidase__InfluenzaA__ACN33049

SEQ ID NO: 169146 - RNA, 1410 nt, Artificial Sequence; identical to SEQ ID NO: 169119
  derived and/or modified sequence opt4 from neuraminidase__InfluenzaA__ACN33060

SEQ ID NO: 169147 - RNA, 1410 nt, Artificial Sequence; identical to SEQ ID NO: 169123
  derived and/or modified sequence opt4 from neuraminidase__InfluenzaA__ACN33082

SEQ ID NO: 169148 - RNA, 1413 nt, Artificial Sequence; identical to SEQ ID NO: 168589
  derived and/or modified sequence opt4 from neuraminidase__InfluenzaA__ACN33093

SEQ ID NO: 169149 - RNA, 1413 nt, Artificial Sequence; identical to SEQ ID NO: 168550
  derived and/or modified sequence opt4 from neuraminidase__InfluenzaA__ACN33104

SEQ ID NO: 169150 - RNA, 1410 nt, Artificial Sequence; identical to SEQ ID NO: 169123
  derived and/or modified sequence opt4 from neuraminidase__InfluenzaA__ACN33115

SEQ ID NO: 169151 - RNA, 1413 nt, Artificial Sequence
  derived and/or modified sequence opt4 from neuraminidase__InfluenzaA__ACN33126
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcagcagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169152 - RNA, 1413 nt, Artificial Sequence
  derived and/or modified sequence opt4 from neuraminidase__InfluenzaA__ACN33148
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169153 - RNA, 1410 nt, Artificial Sequence
  derived and/or modified sequence opt4 from neuraminidase__InfluenzaA__ACN33159
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaagugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169154 - RNA, 1410 nt, Artificial Sequence; identical to SEQ ID NO: 169032
  derived and/or modified sequence opt4 from neuraminidase__InfluenzaA__ACN33170

SEQ ID NO: 169155 - RNA, 1410 nt, Artificial Sequence; identical to SEQ ID NO: 169123
  derived and/or modified sequence opt4 from neuraminidase__InfluenzaA__ACN33181

SEQ ID NO: 169156 - RNA, 1410 nt, Artificial Sequence; identical to SEQ ID NO: 169123
  derived and/or modified sequence opt4 from neuraminidase__InfluenzaA__ACN33203

SEQ ID NO: 169157 - RNA, 1410 nt, Artificial Sequence
  derived and/or modified sequence opt4 from neuraminidase__InfluenzaA__ACN33214
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaccguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169158 - RNA, 1413 nt, Artificial Sequence; identical to SEQ ID NO: 168591
  derived and/or modified sequence opt4 from neuraminidase__InfluenzaA__ACN42984

SEQ ID NO: 169159 - RNA, 1413 nt, Artificial Sequence; identical to SEQ ID NO: 168591
  derived and/or modified sequence opt4 from neuraminidase__InfluenzaA__ACN42995

SEQ ID NO: 169160 - RNA, 1410 nt, Artificial Sequence
  derived and/or modified sequence opt4 from neuraminidase__InfluenzaA__ACN43006
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaacagagugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169161 - RNA, 1410 nt, Artificial Sequence; identical to SEQ ID NO: 169123
  derived and/or modified sequence opt4 from neuraminidase__InfluenzaA__ACN43017

SEQ ID NO: 169162 - RNA, 1410 nt, Artificial Sequence; identical to SEQ ID NO: 169119
  derived and/or modified sequence opt4 from neuraminidase__InfluenzaA__ACN43028

SEQ ID NO: 169163 - RNA, 1410 nt, Artificial Sequence
  derived and/or modified sequence opt4 from neuraminidase__InfluenzaA__ACN43039
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccuggagaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169164 - RNA, 1410 nt, Artificial Sequence; identical to SEQ ID NO: 169032
  derived and/or modified sequence opt4 from neuraminidase__InfluenzaA__ACN43050

SEQ ID NO: 169165 - RNA, 1410 nt, Artificial Sequence; identical to SEQ ID NO: 169119
  derived and/or modified sequence opt4 from neuraminidase__InfluenzaA__ACN43061

SEQ ID NO: 169166 - RNA, 1410 nt, Artificial Sequence
  derived and/or modified sequence opt4 from neuraminidase__InfluenzaA__ACN43072
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcguggugguguucugcggcaccagcggcaccuacggcaccggcagcuggcccgacggcgccgacaucaaccugaugcccaucuga

SEQ ID NO: 169167 - RNA, 1410 nt, Artificial Sequence
  derived and/or modified sequence opt4 from neuraminidase__InfluenzaA__ACN43083
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaacgagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169168 - RNA, 1410 nt, Artificial Sequence; identical to SEQ ID NO: 166847
  derived and/or modified sequence opt4 from neuraminidase__InfluenzaA__ACN50231

SEQ ID NO: 169169 - RNA, 1410 nt, Artificial Sequence
  derived and/or modified sequence opt4 from neuraminidase__InfluenzaA__ACN50233
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugcugaccgacggcagcgccagcggcaaggccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169170 - RNA, 1410 nt, Artificial Sequence
  derived and/or modified sequence opt4 from neuraminidase__InfluenzaA__ACN50245
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagguggugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169171 - RNA, 1413 nt, Artificial Sequence
  derived and/or modified sequence opt4 from neuraminidase__InfluenzaA__ACN72609
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuacaagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169172 - RNA, 1410 nt, Artificial Sequence
  derived and/or modified sequence opt4 from neuraminidase__InfluenzaA__ACN72621
augaaccccaaccagaagaucaucaucaucagcagcaucugcaugaccaacggcaucgccagccugauccugcagaucggcaacaucaucagcaucuggaucagccacagcauccagaccggcaaccagaaccagaccgagaccugcaaccagagcgugaucaucuacgagaacaacaccugggugaaccagaccuacgugaacaucagcaacaacaacuucguggccgagcagaccguggugcccgugaagcuggugggcagcagcccccugugccccgugagcggcugggccaucuacagcaaggacaacagcgugagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccaucggcgaggugcccagccccuacaacagcagauucgagagcguggccuggagcgccagcgccugccacgacggcagcagcuggcugaccaucggcaucagcggccccgacaacggcgccguggccgugcugaaguacaacgacaucaucaccgacaccaucaagagcuggaagaacaacauccugagaacccaggagagcgagugcgccugccugaacggcagcugcuucaccgugaugaccgacggccccagcaacggccaggccagcuacaagaucuucaagaucgagaagggcaagguggugaagagcguggagcugaacgcccccaacuaccacuacgaggagugcagcugcuaccccgacagcggcgagaucaucugcgugugcagagacaacuggcacggcagcaacagacccugggugagcuucaaccagaaccuggaguaccagaucggcuacaucugcagcggcgugcugggcgacaaccccagacccaacgacagaaccggcaacugcggccccgugagcagccacggcgccaacggcgugaagggcuucagcuucaaguacggcgacggcaucuggaucggcagaaccaagagcaccagcagcagaagcggcuucgagaugaucugggaccccaacggcuggaccggcaccgacaacaacuucagcgugaagcaggacaucgugggcaucaccgacuggaccggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169173 - RNA, 1410 nt, Artificial Sequence; identical to SEQ ID NO: 169032
  derived and/or modified sequence opt4 from neuraminidase__InfluenzaA__ACN76503

SEQ ID NO: 169174 - RNA, 1410 nt, Artificial Sequence
  derived and/or modified sequence opt4 from neuraminidase__InfluenzaA__ACO36345
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcagugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169175 - RNA, 1410 nt, Artificial Sequence; identical to SEQ ID NO: 167500
  derived and/or modified sequence opt4 from neuraminidase__InfluenzaA__ACO36356

SEQ ID NO: 169176 - RNA, 1410 nt, Artificial Sequence
  derived and/or modified sequence opt4 from neuraminidase__InfluenzaA__ACO36367
augaaccccaaccagaagaucaucaccaucggcagcgugagccugaucaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuucggcaccggcagcuggcccgacggcgccgacaucaaccugaugcccaucuga

SEQ ID NO: 169177 - RNA, 1413 nt, Artificial Sequence; identical to SEQ ID NO: 169152
  derived and/or modified sequence opt4 from neuraminidase__InfluenzaA__ACO36400

SEQ ID NO: 169178 - RNA, 1410 nt, Artificial Sequence
  derived and/or modified sequence opt4 from neuraminidase__InfluenzaA__ACO36411
augaaccccaaccagaagaucaucaccaucggcagcgugagccugaccaucagcaccaucggcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169179 - RNA, 1410 nt, Artificial Sequence
  derived and/or modified sequence opt4 from neuraminidase__InfluenzaA__ACO36422
augaaccccaaccagaagaucaucaccaucggcagcgugagccugaucaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169180 - RNA, 1410 nt, Artificial Sequence; identical to SEQ ID NO: 168936
  derived and/or modified sequence opt4 from neuraminidase__InfluenzaA__ACO36433

SEQ ID NO: 169181 - RNA, 1410 nt, Artificial Sequence
  derived and/or modified sequence opt4 from neuraminidase__InfluenzaA__ACO36444
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaagugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcgagaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 169182 - RNA, 1410 nt, Artificial Sequence
  derived and/or modified sequence opt4 from neuraminidase__InfluenzaA__ACO36466
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucgccuaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 169183 - RNA, 1410 nt, Artificial Sequence
  derived and/or modified sequence opt4 from neuraminidase__InfluenzaA__ACO36477
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 169184 - RNA, 1410 nt, Artificial Sequence
  derived and/or modified sequence opt4 from neuraminidase__InfluenzaA__ACO36499
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 169185 - RNA, 1410 nt, Artificial Sequence; identical to SEQ ID NO: 166847
  derived and/or modified sequence opt4 from neuraminidase__InfluenzaA__ACO36510

SEQ ID NO: 169186 - RNA, 1410 nt, Artificial Sequence; identical to SEQ ID NO: 166847
  derived and/or modified sequence opt4 from neuraminidase__InfluenzaA__ACO36543

SEQ ID NO: 169187 - RNA, 1410 nt, Artificial Sequence; identical to SEQ ID NO: 166847
  derived and/or modified sequence opt4 from neuraminidase__InfluenzaA__ACO36554

SEQ ID NO: 169188 - RNA, 1410 nt, Artificial Sequence; identical to SEQ ID NO: 166847
  derived and/or modified sequence opt4 from neuraminidase__InfluenzaA__ACO36565

SEQ ID NO: 169189 - RNA, 1410 nt, Artificial Sequence
  derived and/or modified sequence opt4 from neuraminidase__InfluenzaA__ACO36576
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucgugggcagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169190 - RNA, 1410 nt, Artificial Sequence; identical to SEQ ID NO: 166847
  derived and/or modified sequence opt4 from neuraminidase__InfluenzaA__ACO36587

SEQ ID NO: 169191 - RNA, 1410 nt, Artificial Sequence; identical to SEQ ID NO: 167232
  derived and/or modified sequence opt4 from neuraminidase__InfluenzaA__ACO36609

SEQ ID NO: 169192 - RNA, 1410 nt, Artificial Sequence
  derived and/or modified sequence opt4 from neuraminidase__InfluenzaA__ACO36620
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcaggugaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169193 - RNA, 1410 nt, Artificial Sequence; identical to SEQ ID NO: 167232
  derived and/or modified sequence opt4 from neuraminidase__InfluenzaA__ACO36631

SEQ ID NO: 169194 - RNA, 1410 nt, Artificial Sequence; identical to SEQ ID NO: 167232
  derived and/or modified sequence opt4 from neuraminidase__InfluenzaA__ACO36653

SEQ ID NO: 169195 - RNA, 1410 nt, Artificial Sequence
  derived and/or modified sequence opt4 from neuraminidase__InfluenzaA__ACO36675
augaaccccaaccagaagaucaucaccaucggcagcgugagccugaccaucagcaccaucugccuguucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169196 - RNA, 1410 nt, Artificial Sequence
  derived and/or modified sequence opt4 from neuraminidase__InfluenzaA__ACO36686
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccacgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169197 - RNA, 1410 nt, Artificial Sequence
  derived and/or modified sequence opt4 from neuraminidase__InfluenzaA__ACO37125
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcaugcugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169198 - RNA, 1410 nt, Artificial Sequence
  derived and/or modified sequence opt4 from neuraminidase__InfluenzaA__ACO94511
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagcaacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169199 - RNA, 1410 nt, Artificial Sequence; identical to SEQ ID NO: 169032
  derived and/or modified sequence opt4 from neuraminidase__InfluenzaA__ACO94512

SEQ ID NO: 169200 - RNA, 1410 nt, Artificial Sequence; identical to SEQ ID NO: 169119
  derived and/or modified sequence opt4 from neuraminidase__InfluenzaA__ACO94513

SEQ ID NO: 169201 - RNA, 1410 nt, Artificial Sequence
  derived and/or modified sequence opt4 from neuraminidase__InfluenzaA__ACO94675
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169202 - RNA, 1410 nt, Artificial Sequence
  derived and/or modified sequence opt4 from neuraminidase__InfluenzaA__ACO94686
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaccaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgagaucaaccugaugcccaucuga

SEQ ID NO: 169203 - RNA, 1410 nt, Artificial Sequence; identical to SEQ ID NO: 169119
  derived and/or modified sequence opt4 from neuraminidase__InfluenzaA__ACO94697

SEQ ID NO: 169204 - RNA, 1413 nt, Artificial Sequence; identical to SEQ ID NO: 169152
  derived and/or modified sequence opt4 from neuraminidase__InfluenzaA__ACO94708

SEQ ID NO: 169205 - RNA, 1410 nt, Artificial Sequence
  derived and/or modified sequence opt4 from neuraminidase__InfluenzaA__ACO94719
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgagaucaaccugaugcccaucuga

SEQ ID NO: 169206 - RNA, 1410 nt, Artificial Sequence
  derived and/or modified sequence opt4 from neuraminidase__InfluenzaA__ACO94741
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagagcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169207 - RNA, 1410 nt, Artificial Sequence; identical to SEQ ID NO: 169123
  derived and/or modified sequence opt4 from neuraminidase__InfluenzaA__ACO94763

SEQ ID NO: 169208 - RNA, 1410 nt, Artificial Sequence
  derived and/or modified sequence opt4 from neuraminidase__InfluenzaA__ACO94774
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcagagccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169209 - RNA, 1410 nt, Artificial Sequence
  derived and/or modified sequence opt4 from neuraminidase__InfluenzaA__ACO94785
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcaagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169210 - RNA, 1410 nt, Artificial Sequence; identical to SEQ ID NO: 169119
  derived and/or modified sequence opt4 from neuraminidase__InfluenzaA__ACO94796

SEQ ID NO: 169211 - RNA, 1413 nt, Artificial Sequence
  derived and/or modified sequence opt4 from neuraminidase__InfluenzaA__ACO94807
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcaccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 169212 - RNA, 1410 nt, Artificial Sequence; identical to SEQ ID NO: 168934
  derived and/or modified sequence opt4 from neuraminidase__InfluenzaA__ACO94818

SEQ ID NO: 169213 - RNA, 1365 nt, Artificial Sequence; identical to SEQ ID NO: 168239
  derived and/or modified sequence opt4 from neuraminidase__InfluenzaA__ACO94829

SEQ ID NO: 169214 - RNA, 1365 nt, Artificial Sequence; identical to SEQ ID NO: 168239
  derived and/or modified sequence opt4 from neuraminidase__InfluenzaA__ACO94840

SEQ ID NO: 169215 - RNA, 1410 nt, Artificial Sequence
  derived and/or modified sequence opt4 from neuraminidase__InfluenzaA__ACO94851
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaucgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169216 - RNA, 1413 nt, Artificial Sequence; identical to SEQ ID NO: 169152
  derived and/or modified sequence opt4 from neuraminidase__InfluenzaA__ACO94873

SEQ ID NO: 169217 - RNA, 1410 nt, Artificial Sequence
  derived and/or modified sequence opt4 from neuraminidase__InfluenzaA__ACO94884
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 169218 - RNA, 1410 nt, Artificial Sequence; identical to SEQ ID NO: 167234
  derived and/or modified sequence opt4 from neuraminidase__InfluenzaA__ACO94906

SEQ ID NO: 169219 - RNA, 1410 nt, Artificial Sequence; identical to SEQ ID NO: 166665
  derived and/or modified sequence opt4 from neuraminidase__InfluenzaA__ACO94917

SEQ ID NO: 169220 - RNA, 1410 nt, Artificial Sequence; identical to SEQ ID NO: 167234
  derived and/or modified sequence opt4 from neuraminidase__InfluenzaA__ACO94928

SEQ ID NO: 169221 - RNA, 1410 nt, Artificial Sequence; identical to SEQ ID NO: 166665
  derived and/or modified sequence opt4 from neuraminidase__InfluenzaA__ACO94939

SEQ ID NO: 169222 - RNA, 1410 nt, Artificial Sequence
  derived and/or modified sequence opt4 from neuraminidase__InfluenzaA__ACO94950
augaaccccaaccagaagaucaucaccaucggcagcgugagccugaccaucagcaccaucugcuuccugaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169223 - RNA, 1410 nt, Artificial Sequence
  derived and/or modified sequence opt4 from neuraminidase__InfluenzaA__ACO94961
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagcugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169224 - RNA, 1410 nt, Artificial Sequence
  derived and/or modified sequence opt4 from neuraminidase__InfluenzaA__ACO94972
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 169225 - RNA, 1410 nt, Artificial Sequence
  derived and/or modified sequence opt4 from neuraminidase__InfluenzaA__ACO95156
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaccugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 169226 - RNA, 1410 nt, Artificial Sequence; identical to SEQ ID NO: 166847
  derived and/or modified sequence opt4 from neuraminidase__InfluenzaA__ACO95174

SEQ ID NO: 169227 - RNA, 1410 nt, Artificial Sequence; identical to SEQ ID NO: 166847
  derived and/or modified sequence opt4 from neuraminidase__InfluenzaA__ACO95185

SEQ ID NO: 169228 - RNA, 1410 nt, Artificial Sequence
  derived and/or modified sequence opt4 from neuraminidase__InfluenzaA__ACO95196
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 169229 - RNA, 1410 nt, Artificial Sequence; identical to SEQ ID NO: 166847
  derived and/or modified sequence opt4 from neuraminidase__InfluenzaA__ACO95207

SEQ ID NO: 169230 - RNA, 1410 nt, Artificial Sequence; identical to SEQ ID NO: 166847
  derived and/or modified sequence opt4 from neuraminidase__InfluenzaA__ACO95218

SEQ ID NO: 169231 - RNA, 1410 nt, Artificial Sequence; identical to SEQ ID NO: 166850
  derived and/or modified sequence opt4 from neuraminidase__InfluenzaA__ACO95229

SEQ ID NO: 169232 - RNA, 1410 nt, Artificial Sequence; identical to SEQ ID NO: 167232
  derived and/or modified sequence opt4 from neuraminidase__InfluenzaA__ACO95240

SEQ ID NO: 169233 - RNA, 1410 nt, Artificial Sequence; identical to SEQ ID NO: 167093
  derived and/or modified sequence opt4 from neuraminidase__InfluenzaA__ACO95262

SEQ ID NO: 169234 - RNA, 1410 nt, Artificial Sequence; identical to SEQ ID NO: 169031
  derived and/or modified sequence opt4 from neuraminidase__InfluenzaA__ACO95273

SEQ ID NO: 169235 - RNA, 1410 nt, Artificial Sequence; identical to SEQ ID NO: 169123
  derived and/or modified sequence opt4 from neuraminidase__InfluenzaA__ACO95306

SEQ ID NO: 169236 - RNA, 1413 nt, Artificial Sequence
  derived and/or modified sequence opt4 from neuraminidase__InfluenzaA__ACO95385
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcgacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169237 - RNA, 1413 nt, Artificial Sequence; identical to SEQ ID NO: 169152
  derived and/or modified sequence opt4 from neuraminidase__InfluenzaA__ACO95407

SEQ ID NO: 169238 - RNA, 1413 nt, Artificial Sequence; identical to SEQ ID NO: 169152
  derived and/or modified sequence opt4 from neuraminidase__InfluenzaA__ACO95418

SEQ ID NO: 169239 - RNA, 1410 nt, Artificial Sequence; identical to SEQ ID NO: 166665
  derived and/or modified sequence opt4 from neuraminidase__InfluenzaA__ACO95429

SEQ ID NO: 169240 - RNA, 1410 nt, Artificial Sequence; identical to SEQ ID NO: 167234
  derived and/or modified sequence opt4 from neuraminidase__InfluenzaA__ACO95440

SEQ ID NO: 169241 - RNA, 1410 nt, Artificial Sequence
  derived and/or modified sequence opt4 from neuraminidase__InfluenzaA__ACO95462
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcugaucuga

SEQ ID NO: 169242 - RNA, 1410 nt, Artificial Sequence; identical to SEQ ID NO: 167232
  derived and/or modified sequence opt4 from neuraminidase__InfluenzaA__ACO95484

SEQ ID NO: 169243 - RNA, 1410 nt, Artificial Sequence; identical to SEQ ID NO: 167232
  derived and/or modified sequence opt4 from neuraminidase__InfluenzaA__ACO95495

SEQ ID NO: 169244 - RNA, 1410 nt, Artificial Sequence; identical to SEQ ID NO: 167232
  derived and/or modified sequence opt4 from neuraminidase__InfluenzaA__ACO95506

SEQ ID NO: 169245 - RNA, 1410 nt, Artificial Sequence
  derived and/or modified sequence opt4 from neuraminidase__InfluenzaA__ACO95517
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169246 - RNA, 1410 nt, Artificial Sequence
  derived and/or modified sequence opt4 from neuraminidase__InfluenzaA__ACO95539
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccaacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169247 - RNA, 1413 nt, Artificial Sequence
  derived and/or modified sequence opt4 from neuraminidase__InfluenzaA__ACP20223
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccgugaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169248 - RNA, 1410 nt, Artificial Sequence
  derived and/or modified sequence opt4 from neuraminidase__InfluenzaA__ACP41952
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169249 - RNA, 1410 nt, Artificial Sequence; identical to SEQ ID NO: 169248
  derived and/or modified sequence opt4 from neuraminidase__InfluenzaA__ACP44158

SEQ ID NO: 169250 - RNA, 1413 nt, Artificial Sequence
  derived and/or modified sequence opt4 from neuraminidase__InfluenzaA__ACP44195
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcgacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccugaacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169251 - RNA, 1413 nt, Artificial Sequence; identical to SEQ ID NO: 169152
  derived and/or modified sequence opt4 from neuraminidase__InfluenzaA__ACP44217

SEQ ID NO: 169252 - RNA, 1413 nt, Artificial Sequence; identical to SEQ ID NO: 169152
  derived and/or modified sequence opt4 from neuraminidase__InfluenzaA__ACP44228

SEQ ID NO: 169253 - RNA, 1410 nt, Artificial Sequence; identical to SEQ ID NO: 167234
  derived and/or modified sequence opt4 from neuraminidase__InfluenzaA__ACP44239

SEQ ID NO: 169254 - RNA, 1410 nt, Artificial Sequence
  derived and/or modified sequence opt4 from neuraminidase__InfluenzaA__ACP44250
augaaccccaaccagaagaucaucaccaucggcagcgugagccugaccaucagcaccaucugcuucuucaugcagaucgccauccugaugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169255 - RNA, 1410 nt, Artificial Sequence
  derived and/or modified sequence opt4 from neuraminidase__InfluenzaA__ACP44261
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169256 - RNA, 1410 nt, Artificial Sequence
  derived and/or modified sequence opt4 from neuraminidase__InfluenzaA__ACP44272
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccgugaucaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169257 - RNA, 1410 nt, Artificial Sequence; identical to SEQ ID NO: 169248
  derived and/or modified sequence opt4 from neuraminidase__InfluenzaA__ACQ55360

SEQ ID NO: 169258 - RNA, 1410 nt, Artificial Sequence
  derived and/or modified sequence opt4 from neuraminidase__InfluenzaA__ACQ63236
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169259 - RNA, 1410 nt, Artificial Sequence; identical to SEQ ID NO: 169258
  derived and/or modified sequence opt4 from neuraminidase__InfluenzaA__ACQ63242

SEQ ID NO: 169260 - RNA, 1410 nt, Artificial Sequence; identical to SEQ ID NO: 169258
  derived and/or modified sequence opt4 from neuraminidase__InfluenzaA__ACQ63253

SEQ ID NO: 169261 - RNA, 1410 nt, Artificial Sequence; identical to SEQ ID NO: 169258
  derived and/or modified sequence opt4 from neuraminidase__InfluenzaA__ACQ63262

SEQ ID NO: 169262 - RNA, 1410 nt, Artificial Sequence
  derived and/or modified sequence opt4 from neuraminidase__InfluenzaA__ACQ65694
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggagaggcagcaacagacccaucguggacaucaacaugaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169263 - RNA, 1410 nt, Artificial Sequence
  derived and/or modified sequence opt4 from neuraminidase__InfluenzaA__ACQ65705
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggagaggcagcaacagacccaucguggacaucaacaugaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169264 - RNA, 1410 nt, Artificial Sequence; identical to SEQ ID NO: 169032
  derived and/or modified sequence opt4 from neuraminidase__InfluenzaA__ACQ65716

SEQ ID NO: 169265 - RNA, 1410 nt, Artificial Sequence; identical to SEQ ID NO: 169032
  derived and/or modified sequence opt4 from neuraminidase__InfluenzaA__ACQ65727

SEQ ID NO: 169266 - RNA, 1410 nt, Artificial Sequence; identical to SEQ ID NO: 169119
  derived and/or modified sequence opt4 from neuraminidase__InfluenzaA__ACQ65739

SEQ ID NO: 169267 - RNA, 1410 nt, Artificial Sequence
  derived and/or modified sequence opt4 from neuraminidase__InfluenzaA__ACQ65750
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169268 - RNA, 1413 nt, Artificial Sequence; identical to SEQ ID NO: 169152
  derived and/or modified sequence opt4 from neuraminidase__InfluenzaA__ACQ65761

SEQ ID NO: 169269 - RNA, 1410 nt, Artificial Sequence; identical to SEQ ID NO: 169248
  derived and/or modified sequence opt4 from neuraminidase__InfluenzaA__ACQ73394

SEQ ID NO: 169270 - RNA, 1410 nt, Artificial Sequence; identical to SEQ ID NO: 169248
  derived and/or modified sequence opt4 from neuraminidase__InfluenzaA__ACQ73395

SEQ ID NO: 169271 - RNA, 1410 nt, Artificial Sequence; identical to SEQ ID NO: 169258
  derived and/or modified sequence opt4 from neuraminidase__InfluenzaA__ACQ73396

SEQ ID NO: 169272 - RNA, 1410 nt, Artificial Sequence; identical to SEQ ID NO: 169258
  derived and/or modified sequence opt4 from neuraminidase__InfluenzaA__ACQ76291

SEQ ID NO: 169273 - RNA, 1410 nt, Artificial Sequence
  derived and/or modified sequence opt4 from neuraminidase__InfluenzaA__ACQ76298
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169274 - RNA, 1410 nt, Artificial Sequence; identical to SEQ ID NO: 169258
  derived and/or modified sequence opt4 from neuraminidase__InfluenzaA__ACQ76308

SEQ ID NO: 169275 - RNA, 1410 nt, Artificial Sequence; identical to SEQ ID NO: 169258
  derived and/or modified sequence opt4 from neuraminidase__InfluenzaA__ACQ76316

SEQ ID NO: 169276 - RNA, 1410 nt, Artificial Sequence; identical to SEQ ID NO: 169248
  derived and/or modified sequence opt4 from neuraminidase__InfluenzaA__ACQ76322

SEQ ID NO: 169277 - RNA, 1410 nt, Artificial Sequence; identical to SEQ ID NO: 169248
  derived and/or modified sequence opt4 from neuraminidase__InfluenzaA__ACQ76328

SEQ ID NO: 169278 - RNA, 1410 nt, Artificial Sequence; identical to SEQ ID NO: 169248
  derived and/or modified sequence opt4 from neuraminidase__InfluenzaA__ACQ76335

SEQ ID NO: 169279 - RNA, 1410 nt, Artificial Sequence; identical to SEQ ID NO: 169248
  derived and/or modified sequence opt4 from neuraminidase__InfluenzaA__ACQ76342

SEQ ID NO: 169280 - RNA, 1410 nt, Artificial Sequence; identical to SEQ ID NO: 169248
  derived and/or modified sequence opt4 from neuraminidase__InfluenzaA__ACQ76351

SEQ ID NO: 169281 - RNA, 1410 nt, Artificial Sequence; identical to SEQ ID NO: 169248
  derived and/or modified sequence opt4 from neuraminidase__InfluenzaA__ACQ76359

SEQ ID NO: 169282 - RNA, 1410 nt, Artificial Sequence; identical to SEQ ID NO: 169258
  derived and/or modified sequence opt4 from neuraminidase__InfluenzaA__ACQ76364

SEQ ID NO: 169283 - RNA, 1410 nt, Artificial Sequence; identical to SEQ ID NO: 169258
  derived and/or modified sequence opt4 from neuraminidase__InfluenzaA__ACQ76367

SEQ ID NO: 169284 - RNA, 1410 nt, Artificial Sequence
  derived and/or modified sequence opt4 from neuraminidase__InfluenzaA__ACQ76379
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacaagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169285 - RNA, 1410 nt, Artificial Sequence; identical to SEQ ID NO: 169258
  derived and/or modified sequence opt4 from neuraminidase__InfluenzaA__ACQ76385

SEQ ID NO: 169286 - RNA, 1410 nt, Artificial Sequence; identical to SEQ ID NO: 169258
  derived and/or modified sequence opt4 from neuraminidase__InfluenzaA__ACQ76388

SEQ ID NO: 169287 - RNA, 1410 nt, Artificial Sequence; identical to SEQ ID NO: 169258
  derived and/or modified sequence opt4 from neuraminidase__InfluenzaA__ACQ76403

SEQ ID NO: 169288 - RNA, 1410 nt, Artificial Sequence
  derived and/or modified sequence opt4 from neuraminidase__InfluenzaA__ACQ76407
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugggcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169289 - RNA, 1410 nt, Artificial Sequence
  derived and/or modified sequence opt4 from neuraminidase__InfluenzaA__ACQ77603
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 169290 - RNA, 1410 nt, Artificial Sequence; identical to SEQ ID NO: 169248
  derived and/or modified sequence opt4 from neuraminidase__InfluenzaA__ACQ83309

SEQ ID NO: 169291 - RNA, 1410 nt, Artificial Sequence; identical to SEQ ID NO: 169248
  derived and/or modified sequence opt4 from neuraminidase__InfluenzaA__ACQ84460

SEQ ID NO: 169292 - RNA, 1410 nt, Artificial Sequence; identical to SEQ ID NO: 169248
  derived and/or modified sequence opt4 from neuraminidase__InfluenzaA__ACQ84470

SEQ ID NO: 169293 - RNA, 1410 nt, Artificial Sequence
  derived and/or modified sequence opt4 from neuraminidase__InfluenzaA__ACQ84480
augaacaccaaccagagaaucaucaccaucggcaccgugugccugaucgugggcaucgugagccugcugcugcagaucggcaacaucgugagccuguggaucagccacagcaucaagaccggcgagaagaaccacagcgagaucugcaaccagaacaucaucaccuacgagaacaagaccugggugaaccagaccuacgugaacaucagcaacaccaacaucgccgacggccagggcgugaccagcaucauccuggccggcaacagcagccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacagacacagcaacggcaccgugaaggacagaagccccuacagaacccugaugagcugccccaccggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcguggagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaucaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcguggacagcgagaccgccagcuggagcuggcccgacggcgccgaccugcccuucaccaucgacaaguga

SEQ ID NO: 169294 - RNA, 1410 nt, Artificial Sequence
  derived and/or modified sequence opt4 from neuraminidase__InfluenzaA__ACQ89891
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagaggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169295 - RNA, 1410 nt, Artificial Sequence; identical to SEQ ID NO: 169248
  derived and/or modified sequence opt4 from neuraminidase__InfluenzaA__ACQ89918

SEQ ID NO: 169296 - RNA, 1410 nt, Artificial Sequence
  derived and/or modified sequence opt4 from neuraminidase__InfluenzaA__ACQ89919
augaaccccaaccagaagaucaucaccaucggcagcgugugcaugaccaucggcauggccaaccugauccugcagaucggcaacaucaucagcaucuggaucagcagaagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169297 - RNA, 1410 nt, Artificial Sequence; identical to SEQ ID NO: 169258
  derived and/or modified sequence opt4 from neuraminidase__InfluenzaA__ACQ89920

SEQ ID NO: 169298 - RNA, 1410 nt, Artificial Sequence; identical to SEQ ID NO: 169258
  derived and/or modified sequence opt4 from neuraminidase__InfluenzaA__ACQ89921

SEQ ID NO: 169299 - RNA, 1410 nt, Artificial Sequence; identical to SEQ ID NO: 169248
  derived and/or modified sequence opt4 from neuraminidase__InfluenzaA__ACQ89922

SEQ ID NO: 169300 - RNA, 1410 nt, Artificial Sequence; identical to SEQ ID NO: 169258
  derived and/or modified sequence opt4 from neuraminidase__InfluenzaA__ACQ89923

SEQ ID NO: 169301 - RNA, 1410 nt, Artificial Sequence; identical to SEQ ID NO: 169248
  derived and/or modified sequence opt4 from neuraminidase__InfluenzaA__ACQ99623

SEQ ID NO: 169302 - RNA, 1410 nt, Artificial Sequence; identical to SEQ ID NO: 169258
  derived and/or modified sequence opt4 from neuraminidase__InfluenzaA__ACQ99624

SEQ ID NO: 169303 - RNA, 1410 nt, Artificial Sequence; identical to SEQ ID NO: 169248
  derived and/or modified sequence opt4 from neuraminidase__InfluenzaA__ACQ99626

SEQ ID NO: 169304 - RNA, 1410 nt, Artificial Sequence; identical to SEQ ID NO: 169248
  derived and/or modified sequence opt4 from neuraminidase__InfluenzaA__ACQ99627

SEQ ID NO: 169305 - RNA, 1410 nt, Artificial Sequence; identical to SEQ ID NO: 169248
  derived and/or modified sequence opt4 from neuraminidase__InfluenzaA__ACQ99628

SEQ ID NO: 169306 - RNA, 1410 nt, Artificial Sequence; identical to SEQ ID NO: 169248
  derived and/or modified sequence opt4 from neuraminidase__InfluenzaA__ACQ99629

SEQ ID NO: 169307 - RNA, 1410 nt, Artificial Sequence; identical to SEQ ID NO: 169248
  derived and/or modified sequence opt4 from neuraminidase__InfluenzaA__ACQ99630

SEQ ID NO: 169308 - RNA, 1410 nt, Artificial Sequence; identical to SEQ ID NO: 169258
  derived and/or modified sequence opt4 from neuraminidase__InfluenzaA__ACQ99632

SEQ ID NO: 169309 - RNA, 1410 nt, Artificial Sequence; identical to SEQ ID NO: 169258
  derived and/or modified sequence opt4 from neuraminidase__InfluenzaA__ACQ99633

SEQ ID NO: 169310 - RNA, 1410 nt, Artificial Sequence; identical to SEQ ID NO: 169248
  derived and/or modified sequence opt4 from neuraminidase__InfluenzaA__ACQ99635

SEQ ID NO: 169311 - RNA, 1410 nt, Artificial Sequence; identical to SEQ ID NO: 169248
  derived and/or modified sequence opt4 from neuraminidase__InfluenzaA__ACQ99636

SEQ ID NO: 169312 - RNA, 1410 nt, Artificial Sequence
  derived and/or modified sequence opt4 from neuraminidase__InfluenzaA__ACQ99684
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacgagcaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169313 - RNA, 1410 nt, Artificial Sequence
  derived and/or modified sequence opt4 from neuraminidase__InfluenzaA__ACQ99824
augaacaccaaccagagaaucaucaccaucggcaccaucugccugaucgugggcaucaucagccugcugcugcagaucggcaacaucauccugcuguggaugagccacagcauccagaccggcgagaagagccaccccaaggugugcaaccagagcgugaucaccuacgagaacaacaccugggugaaccagaccuacgugaacaucagcaacaccaacaucgccgccggccagggcgugacccccaucauccuggccggcaacagcagccugugccccaucagcggcugggccaucuacagcaaggacaacagcaucagaaucggcagcaagggcgacaucuucgugaugagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagcuguucaagauggagaagggcaagaucaucaagagcaucgagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcgugaacagcggcaccgccagcuggagcuggcccgacggcgccgaccugcccuucaccaucgacaaguga

SEQ ID NO: 169314 - RNA, 1410 nt, Artificial Sequence; identical to SEQ ID NO: 169258
  derived and/or modified sequence opt4 from neuraminidase__InfluenzaA__ACR01015

SEQ ID NO: 169315 - RNA, 1410 nt, Artificial Sequence; identical to SEQ ID NO: 169258
  derived and/or modified sequence opt4 from neuraminidase__InfluenzaA__ACR08422

SEQ ID NO: 169316 - RNA, 1410 nt, Artificial Sequence; identical to SEQ ID NO: 169258
  derived and/or modified sequence opt4 from neuraminidase__InfluenzaA__ACR08432

SEQ ID NO: 169317 - RNA, 1410 nt, Artificial Sequence; identical to SEQ ID NO: 169258
  derived and/or modified sequence opt4 from neuraminidase__InfluenzaA__ACR08442

SEQ ID NO: 169318 - RNA, 1410 nt, Artificial Sequence; identical to SEQ ID NO: 169258
  derived and/or modified sequence opt4 from neuraminidase__InfluenzaA__ACR08452

SEQ ID NO: 169319 - RNA, 1410 nt, Artificial Sequence
  derived and/or modified sequence opt4 from neuraminidase__InfluenzaA__ACR08462
augagccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169320 - RNA, 1410 nt, Artificial Sequence
  derived and/or modified sequence opt4 from neuraminidase__InfluenzaA__ACR08565
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169321 - RNA, 1410 nt, Artificial Sequence; identical to SEQ ID NO: 169248
  derived and/or modified sequence opt4 from neuraminidase__InfluenzaA__ACR08566

SEQ ID NO: 169322 - RNA, 1410 nt, Artificial Sequence; identical to SEQ ID NO: 169258
  derived and/or modified sequence opt4 from neuraminidase__InfluenzaA__ACR08567

SEQ ID NO: 169323 - RNA, 1410 nt, Artificial Sequence; identical to SEQ ID NO: 169248
  derived and/or modified sequence opt4 from neuraminidase__InfluenzaA__ACR08568

SEQ ID NO: 169324 - RNA, 1410 nt, Artificial Sequence; identical to SEQ ID NO: 169248
  derived and/or modified sequence opt4 from neuraminidase__InfluenzaA__ACR08569

SEQ ID NO: 169325 - RNA, 1410 nt, Artificial Sequence; identical to SEQ ID NO: 169258
  derived and/or modified sequence opt4 from neuraminidase__InfluenzaA__ACR08570

SEQ ID NO: 169326 - RNA, 1410 nt, Artificial Sequence; identical to SEQ ID NO: 169248
  derived and/or modified sequence opt4 from neuraminidase__InfluenzaA__ACR08571

SEQ ID NO: 169327 - RNA, 1410 nt, Artificial Sequence; identical to SEQ ID NO: 169248
  derived and/or modified sequence opt4 from neuraminidase__InfluenzaA__ACR08572

SEQ ID NO: 169328 - RNA, 1410 nt, Artificial Sequence; identical to SEQ ID NO: 169248
  derived and/or modified sequence opt4 from neuraminidase__InfluenzaA__ACR08573

SEQ ID NO: 169329 - RNA, 1410 nt, Artificial Sequence; identical to SEQ ID NO: 169248
  derived and/or modified sequence opt4 from neuraminidase__InfluenzaA__ACR08574

SEQ ID NO: 169330 - RNA, 1410 nt, Artificial Sequence; identical to SEQ ID NO: 169258
  derived and/or modified sequence opt4 from neuraminidase__InfluenzaA__ACR08576

SEQ ID NO: 169331 - RNA, 1410 nt, Artificial Sequence; identical to SEQ ID NO: 169248
  derived and/or modified sequence opt4 from neuraminidase__InfluenzaA__ACR08577

SEQ ID NO: 169332 - RNA, 1410 nt, Artificial Sequence; identical to SEQ ID NO: 169248
  derived and/or modified sequence opt4 from neuraminidase__InfluenzaA__ACR09378

SEQ ID NO: 169333 - RNA, 1410 nt, Artificial Sequence; identical to SEQ ID NO: 169248
  derived and/or modified sequence opt4 from neuraminidase__InfluenzaA__ACR09379

SEQ ID NO: 169334 - RNA, 1410 nt, Artificial Sequence; identical to SEQ ID NO: 169258
  derived and/or modified sequence opt4 from neuraminidase__InfluenzaA__ACR09380

SEQ ID NO: 169335 - RNA, 1410 nt, Artificial Sequence; identical to SEQ ID NO: 169248
  derived and/or modified sequence opt4 from neuraminidase__InfluenzaA__ACR09381

SEQ ID NO: 169336 - RNA, 1410 nt, Artificial Sequence; identical to SEQ ID NO: 169248
  derived and/or modified sequence opt4 from neuraminidase__InfluenzaA__ACR09382

SEQ ID NO: 169337 - RNA, 1410 nt, Artificial Sequence; identical to SEQ ID NO: 169258
  derived and/or modified sequence opt4 from neuraminidase__InfluenzaA__ACR09383

SEQ ID NO: 169338 - RNA, 1410 nt, Artificial Sequence; identical to SEQ ID NO: 169248
  derived and/or modified sequence opt4 from neuraminidase__InfluenzaA__ACR09384

SEQ ID NO: 169339 - RNA, 1410 nt, Artificial Sequence; identical to SEQ ID NO: 169258
  derived and/or modified sequence opt4 from neuraminidase__InfluenzaA__ACR09385

SEQ ID NO: 169340 - RNA, 1410 nt, Artificial Sequence; identical to SEQ ID NO: 169248
  derived and/or modified sequence opt4 from neuraminidase__InfluenzaA__ACR09386

SEQ ID NO: 169341 - RNA, 1410 nt, Artificial Sequence; identical to SEQ ID NO: 169258
  derived and/or modified sequence opt4 from neuraminidase__InfluenzaA__ACR10189

SEQ ID NO: 169342 - RNA, 1410 nt, Artificial Sequence; identical to SEQ ID NO: 169258
  derived and/or modified sequence opt4 from neuraminidase__InfluenzaA__ACR10226

SEQ ID NO: 169343 - RNA, 1410 nt, Artificial Sequence; identical to SEQ ID NO: 169248
  derived and/or modified sequence opt4 from neuraminidase__InfluenzaA__ACR10236

SEQ ID NO: 169344 - RNA, 1410 nt, Artificial Sequence; identical to SEQ ID NO: 169248
  derived and/or modified sequence opt4 from neuraminidase__InfluenzaA__ACR10237

SEQ ID NO: 169345 - RNA, 1410 nt, Artificial Sequence
  derived and/or modified sequence opt4 from neuraminidase__InfluenzaA__ACR15186
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagacaccccggcgugagaugcgugugcagagacaacuggagaggcagcaacagacccaucguggacaucaacaugaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169346 - RNA, 1413 nt, Artificial Sequence; identical to SEQ ID NO: 169152
  derived and/or modified sequence opt4 from neuraminidase__InfluenzaA__ACR15197

SEQ ID NO: 169347 - RNA, 1410 nt, Artificial Sequence
  derived and/or modified sequence opt4 from neuraminidase__InfluenzaA__ACR15208
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169348 - RNA, 1410 nt, Artificial Sequence
  derived and/or modified sequence opt4 from neuraminidase__InfluenzaA__ACR15230
auggaccccaaccagaagaucaucaccaucggcagcgugagccugaccaucagcgccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcaacagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 169349 - RNA, 1413 nt, Artificial Sequence; identical to SEQ ID NO: 169152
  derived and/or modified sequence opt4 from neuraminidase__InfluenzaA__ACR15241

SEQ ID NO: 169350 - RNA, 1410 nt, Artificial Sequence; identical to SEQ ID NO: 168404
  derived and/or modified sequence opt4 from neuraminidase__InfluenzaA__ACR15252

SEQ ID NO: 169351 - RNA, 1413 nt, Artificial Sequence
  derived and/or modified sequence opt4 from neuraminidase__InfluenzaA__ACR15263
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggagcagcggcagcagcaucagcuucugcggcgugaacagcgacaccgccaacuggagcuggcccgacggcgccgagcugcccuucaccaucgacaaguga

SEQ ID NO: 169352 - RNA, 1413 nt, Artificial Sequence; identical to SEQ ID NO: 169152
  derived and/or modified sequence opt4 from neuraminidase__InfluenzaA__ACR15274

SEQ ID NO: 169353 - RNA, 1413 nt, Artificial Sequence
  derived and/or modified sequence opt4 from neuraminidase__InfluenzaA__ACR15307
augaaccccaaccagaagaucaucaccaucggcagcaucagcaucaccaucggcaucaucagccugaugcugcagaucggcaacaucaucagcaucugggccagccacagcauccagaccggcagccagaaccacaccggcaucugcaaccagagaaucaucaccuacgagaacaacaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169354 - RNA, 1413 nt, Artificial Sequence
  derived and/or modified sequence opt4 from neuraminidase__InfluenzaA__ACR15318
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagagacagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 169355 - RNA, 1413 nt, Artificial Sequence
  derived and/or modified sequence opt4 from neuraminidase__InfluenzaA__ACR15329
augaaccccaaccagaagaucaucaccaucggcagcaucagcaucgccaucggcaucaucagccugaugcugcagaucggcaacaucaucagcaucugggccagccacagcauccagaccagaagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 169356 - RNA, 1413 nt, Artificial Sequence; identical to SEQ ID NO: 169152
  derived and/or modified sequence opt4 from neuraminidase__InfluenzaA__ACR15340

SEQ ID NO: 169357 - RNA, 1413 nt, Artificial Sequence; identical to SEQ ID NO: 169152
  derived and/or modified sequence opt4 from neuraminidase__InfluenzaA__ACR15362

SEQ ID NO: 169358 - RNA, 1413 nt, Artificial Sequence; identical to SEQ ID NO: 169152
  derived and/or modified sequence opt4 from neuraminidase__InfluenzaA__ACR15373

SEQ ID NO: 169359 - RNA, 1413 nt, Artificial Sequence
  derived and/or modified sequence opt4 from neuraminidase__InfluenzaA__ACR15428
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcgugagcggcugggccaucuacaccaaggacaacagcaucagaaucggcagcaagggcgacguguucgugaucagagagcccuucaucagcugcagccaccuggagugcagaaccuucuuccugaccaagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169360 - RNA, 1413 nt, Artificial Sequence
  derived and/or modified sequence opt4 from neuraminidase__InfluenzaA__ACR15472
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagacccccgugacccuggccggcaacagcagccugugcagcaucagcggcugggccaucuacaccaaggacaacagcaucagaaucggcagcaagggcgacguguucgugaucagagagcccuucaucgccugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgaggugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169361 - RNA, 1413 nt, Artificial Sequence; identical to SEQ ID NO: 169152
  derived and/or modified sequence opt4 from neuraminidase__InfluenzaA__ACR15483

SEQ ID NO: 169362 - RNA, 1413 nt, Artificial Sequence; identical to SEQ ID NO: 169152
  derived and/or modified sequence opt4 from neuraminidase__InfluenzaA__ACR15505

SEQ ID NO: 169363 - RNA, 1413 nt, Artificial Sequence; identical to SEQ ID NO: 169236
  derived and/or modified sequence opt4 from neuraminidase__InfluenzaA__ACR15516

SEQ ID NO: 169364 - RNA, 1410 nt, Artificial Sequence; identical to SEQ ID NO: 167234
  derived and/or modified sequence opt4 from neuraminidase__InfluenzaA__ACR15527

SEQ ID NO: 169365 - RNA, 1410 nt, Artificial Sequence
  derived and/or modified sequence opt4 from neuraminidase__InfluenzaA__ACR15538
augauccccauccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169366 - RNA, 1410 nt, Artificial Sequence; identical to SEQ ID NO: 166847
  derived and/or modified sequence opt4 from neuraminidase__InfluenzaA__ACR15549

SEQ ID NO: 169367 - RNA, 1410 nt, Artificial Sequence; identical to SEQ ID NO: 167232
  derived and/or modified sequence opt4 from neuraminidase__InfluenzaA__ACR15560

SEQ ID NO: 169368 - RNA, 1410 nt, Artificial Sequence; identical to SEQ ID NO: 167232
  derived and/or modified sequence opt4 from neuraminidase__InfluenzaA__ACR15582

SEQ ID NO: 169369 - RNA, 1410 nt, Artificial Sequence
  derived and/or modified sequence opt4 from neuraminidase__InfluenzaA__ACR15593
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcaggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169370 - RNA, 1410 nt, Artificial Sequence
  derived and/or modified sequence opt4 from neuraminidase__InfluenzaA__ACR15604
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169371 - RNA, 1410 nt, Artificial Sequence; identical to SEQ ID NO: 169248
  derived and/or modified sequence opt4 from neuraminidase__InfluenzaA__ACR15618

SEQ ID NO: 169372 - RNA, 1410 nt, Artificial Sequence; identical to SEQ ID NO: 169248
  derived and/or modified sequence opt4 from neuraminidase__InfluenzaA__ACR18924

SEQ ID NO: 169373 - RNA, 1410 nt, Artificial Sequence; identical to SEQ ID NO: 169248
  derived and/or modified sequence opt4 from neuraminidase__InfluenzaA__ACR18925

SEQ ID NO: 169374 - RNA, 1410 nt, Artificial Sequence; identical to SEQ ID NO: 169258
  derived and/or modified sequence opt4 from neuraminidase__InfluenzaA__ACR18926

SEQ ID NO: 169375 - RNA, 1410 nt, Artificial Sequence; identical to SEQ ID NO: 169258
  derived and/or modified sequence opt4 from neuraminidase__InfluenzaA__ACR18927

SEQ ID NO: 169376 - RNA, 1410 nt, Artificial Sequence; identical to SEQ ID NO: 169258
  derived and/or modified sequence opt4 from neuraminidase__InfluenzaA__ACR18928

SEQ ID NO: 169377 - RNA, 1410 nt, Artificial Sequence; identical to SEQ ID NO: 169258
  derived and/or modified sequence opt4 from neuraminidase__InfluenzaA__ACR18929

SEQ ID NO: 169378 - RNA, 1410 nt, Artificial Sequence; identical to SEQ ID NO: 169258
  derived and/or modified sequence opt4 from neuraminidase__InfluenzaA__ACR18930

SEQ ID NO: 169379 - RNA, 1410 nt, Artificial Sequence; identical to SEQ ID NO: 169258
  derived and/or modified sequence opt4 from neuraminidase__InfluenzaA__ACR18931

SEQ ID NO: 169380 - RNA, 1410 nt, Artificial Sequence; identical to SEQ ID NO: 169258
  derived and/or modified sequence opt4 from neuraminidase__InfluenzaA__ACR18933

SEQ ID NO: 169381 - RNA, 1410 nt, Artificial Sequence; identical to SEQ ID NO: 169248
  derived and/or modified sequence opt4 from neuraminidase__InfluenzaA__ACR18934

SEQ ID NO: 169382 - RNA, 1410 nt, Artificial Sequence; identical to SEQ ID NO: 169258
  derived and/or modified sequence opt4 from neuraminidase__InfluenzaA__ACR18935

SEQ ID NO: 169383 - RNA, 1410 nt, Artificial Sequence; identical to SEQ ID NO: 169258
  derived and/or modified sequence opt4 from neuraminidase__InfluenzaA__ACR23301

SEQ ID NO: 169384 - RNA, 1410 nt, Artificial Sequence; identical to SEQ ID NO: 169258
  derived and/or modified sequence opt4 from neuraminidase__InfluenzaA__ACR32997

SEQ ID NO: 169385 - RNA, 1410 nt, Artificial Sequence
  derived and/or modified sequence opt4 from neuraminidase__InfluenzaA__ACR33740
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 169386 - RNA, 1410 nt, Artificial Sequence; identical to SEQ ID NO: 169248
  derived and/or modified sequence opt4 from neuraminidase__InfluenzaA__ACR38792

SEQ ID NO: 169387 - RNA, 1410 nt, Artificial Sequence; identical to SEQ ID NO: 169258
  derived and/or modified sequence opt4 from neuraminidase__InfluenzaA__ACR38793

SEQ ID NO: 169388 - RNA, 1410 nt, Artificial Sequence; identical to SEQ ID NO: 169258
  derived and/or modified sequence opt4 from neuraminidase__InfluenzaA__ACR38794

SEQ ID NO: 169389 - RNA, 1410 nt, Artificial Sequence; identical to SEQ ID NO: 169258
  derived and/or modified sequence opt4 from neuraminidase__InfluenzaA__ACR38878

SEQ ID NO: 169390 - RNA, 1410 nt, Artificial Sequence; identical to SEQ ID NO: 169258
  derived and/or modified sequence opt4 from neuraminidase__InfluenzaA__ACR39357

SEQ ID NO: 169391 - RNA, 1410 nt, Artificial Sequence; identical to SEQ ID NO: 169258
  derived and/or modified sequence opt4 from neuraminidase__InfluenzaA__ACR39396

SEQ ID NO: 169392 - RNA, 1410 nt, Artificial Sequence; identical to SEQ ID NO: 169258
  derived and/or modified sequence opt4 from neuraminidase__InfluenzaA__ACR39406

SEQ ID NO: 169393 - RNA, 1410 nt, Artificial Sequence; identical to SEQ ID NO: 169258
  derived and/or modified sequence opt4 from neuraminidase__InfluenzaA__ACR39416

SEQ ID NO: 169394 - RNA, 1410 nt, Artificial Sequence; identical to SEQ ID NO: 169258
  derived and/or modified sequence opt4 from neuraminidase__InfluenzaA__ACR39426

SEQ ID NO: 169395 - RNA, 1410 nt, Artificial Sequence; identical to SEQ ID NO: 169258
  derived and/or modified sequence opt4 from neuraminidase__InfluenzaA__ACR39436

SEQ ID NO: 169396 - RNA, 1410 nt, Artificial Sequence; identical to SEQ ID NO: 169258
  derived and/or modified sequence opt4 from neuraminidase__InfluenzaA__ACR39446

SEQ ID NO: 169397 - RNA, 1410 nt, Artificial Sequence; identical to SEQ ID NO: 169258
  derived and/or modified sequence opt4 from neuraminidase__InfluenzaA__ACR39456

SEQ ID NO: 169398 - RNA, 1410 nt, Artificial Sequence; identical to SEQ ID NO: 169258
  derived and/or modified sequence opt4 from neuraminidase__InfluenzaA__ACR39466

SEQ ID NO: 169399 - RNA, 1410 nt, Artificial Sequence; identical to SEQ ID NO: 169258
  derived and/or modified sequence opt4 from neuraminidase__InfluenzaA__ACR39476

SEQ ID NO: 169400 - RNA, 1410 nt, Artificial Sequence; identical to SEQ ID NO: 169258
  derived and/or modified sequence opt4 from neuraminidase__InfluenzaA__ACR39486

SEQ ID NO: 169401 - RNA, 1410 nt, Artificial Sequence; identical to SEQ ID NO: 169258
  derived and/or modified sequence opt4 from neuraminidase__InfluenzaA__ACR39496

SEQ ID NO: 169402 - RNA, 1410 nt, Artificial Sequence; identical to SEQ ID NO: 169258
  derived and/or modified sequence opt4 from neuraminidase__InfluenzaA__ACR40291

SEQ ID NO: 169403 - RNA, 1410 nt, Artificial Sequence; identical to SEQ ID NO: 169258
  derived and/or modified sequence opt4 from neuraminidase__InfluenzaA__ACR40301

SEQ ID NO: 169404 - RNA, 1410 nt, Artificial Sequence
  derived and/or modified sequence opt4 from neuraminidase__InfluenzaA__ACR40311
augaaccccaaccagaagaucaucaccaucggcagcgugugcaugaccaucggcauggccaaccugauccugcagaucggcaacaucaucagcaucuggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169405 - RNA, 1410 nt, Artificial Sequence
  derived and/or modified sequence opt4 from neuraminidase__InfluenzaA__ACR40321
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaacggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169406 - RNA, 1410 nt, Artificial Sequence; identical to SEQ ID NO: 169258
  derived and/or modified sequence opt4 from neuraminidase__InfluenzaA__ACR40341

SEQ ID NO: 169407 - RNA, 1410 nt, Artificial Sequence; identical to SEQ ID NO: 169258
  derived and/or modified sequence opt4 from neuraminidase__InfluenzaA__ACR40351

SEQ ID NO: 169408 - RNA, 1410 nt, Artificial Sequence; identical to SEQ ID NO: 169258
  derived and/or modified sequence opt4 from neuraminidase__InfluenzaA__ACR40361

SEQ ID NO: 169409 - RNA, 1410 nt, Artificial Sequence; identical to SEQ ID NO: 169258
  derived and/or modified sequence opt4 from neuraminidase__InfluenzaA__ACR40371

SEQ ID NO: 169410 - RNA, 1410 nt, Artificial Sequence; identical to SEQ ID NO: 169258
  derived and/or modified sequence opt4 from neuraminidase__InfluenzaA__ACR40391

SEQ ID NO: 169411 - RNA, 1410 nt, Artificial Sequence; identical to SEQ ID NO: 169248
  derived and/or modified sequence opt4 from neuraminidase__InfluenzaA__ACR46663

SEQ ID NO: 169412 - RNA, 1410 nt, Artificial Sequence; identical to SEQ ID NO: 169248
  derived and/or modified sequence opt4 from neuraminidase__InfluenzaA__ACR46673

SEQ ID NO: 169413 - RNA, 1410 nt, Artificial Sequence
  derived and/or modified sequence opt4 from neuraminidase__InfluenzaA__ACR46996
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169414 - RNA, 1410 nt, Artificial Sequence; identical to SEQ ID NO: 169413
  derived and/or modified sequence opt4 from neuraminidase__InfluenzaA__ACR46997

SEQ ID NO: 169415 - RNA, 1410 nt, Artificial Sequence; identical to SEQ ID NO: 169413
  derived and/or modified sequence opt4 from neuraminidase__InfluenzaA__ACR46998

SEQ ID NO: 169416 - RNA, 1410 nt, Artificial Sequence; identical to SEQ ID NO: 169413
  derived and/or modified sequence opt4 from neuraminidase__InfluenzaA__ACR46999

SEQ ID NO: 169417 - RNA, 1410 nt, Artificial Sequence; identical to SEQ ID NO: 169413
  derived and/or modified sequence opt4 from neuraminidase__InfluenzaA__ACR47000

SEQ ID NO: 169418 - RNA, 1410 nt, Artificial Sequence; identical to SEQ ID NO: 169413
  derived and/or modified sequence opt4 from neuraminidase__InfluenzaA__ACR47001

SEQ ID NO: 169419 - RNA, 1410 nt, Artificial Sequence; identical to SEQ ID NO: 169413
  derived and/or modified sequence opt4 from neuraminidase__InfluenzaA__ACR47002

SEQ ID NO: 169420 - RNA, 1410 nt, Artificial Sequence; identical to SEQ ID NO: 169413
  derived and/or modified sequence opt4 from neuraminidase__InfluenzaA__ACR47003

SEQ ID NO: 169421 - RNA, 1410 nt, Artificial Sequence
  derived and/or modified sequence opt4 from neuraminidase__InfluenzaA__ACR47008
augaaccccaaccagaagaucaucaccaucggcagcgugugcaugaccaucggcauggccaaccugauccugcagaucggcaacaucaucagcaucuggcccgugcacagcauccagcugggcaaccagaaccagaucgagaccugcaaccagagcgugaucaccuacgagaacaacaccugggugaaccagaccuacgugaacaucagcaacaccaacuucgccgccggccagagcguggugagcaugaagcuggccggcaacagcagccugugccccgugggcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169422 - RNA, 1410 nt, Artificial Sequence; identical to SEQ ID NO: 169258
  derived and/or modified sequence opt4 from neuraminidase__InfluenzaA__ACR49267

SEQ ID NO: 169423 - RNA, 1410 nt, Artificial Sequence; identical to SEQ ID NO: 169248
  derived and/or modified sequence opt4 from neuraminidase__InfluenzaA__ACR49268

SEQ ID NO: 169424 - RNA, 1410 nt, Artificial Sequence; identical to SEQ ID NO: 169248
  derived and/or modified sequence opt4 from neuraminidase__InfluenzaA__ACR49269

SEQ ID NO: 169425 - RNA, 1410 nt, Artificial Sequence; identical to SEQ ID NO: 169248
  derived and/or modified sequence opt4 from neuraminidase__InfluenzaA__ACR49270

SEQ ID NO: 169426 - RNA, 1410 nt, Artificial Sequence; identical to SEQ ID NO: 169288
  derived and/or modified sequence opt4 from neuraminidase__InfluenzaA__ACR49271

SEQ ID NO: 169427 - RNA, 1410 nt, Artificial Sequence; identical to SEQ ID NO: 169258
  derived and/or modified sequence opt4 from neuraminidase__InfluenzaA__ACR49272

SEQ ID NO: 169428 - RNA, 1410 nt, Artificial Sequence; identical to SEQ ID NO: 169248
  derived and/or modified sequence opt4 from neuraminidase__InfluenzaA__ACR49273

SEQ ID NO: 169429 - RNA, 1410 nt, Artificial Sequence; identical to SEQ ID NO: 169248
  derived and/or modified sequence opt4 from neuraminidase__InfluenzaA__ACR49274

SEQ ID NO: 169430 - RNA, 1410 nt, Artificial Sequence; identical to SEQ ID NO: 169288
  derived and/or modified sequence opt4 from neuraminidase__InfluenzaA__ACR49275

SEQ ID NO: 169431 - RNA, 1410 nt, Artificial Sequence; identical to SEQ ID NO: 169288
  derived and/or modified sequence opt4 from neuraminidase__InfluenzaA__ACR49277

SEQ ID NO: 169432 - RNA, 1410 nt, Artificial Sequence; identical to SEQ ID NO: 169288
  derived and/or modified sequence opt4 from neuraminidase__InfluenzaA__ACR49278

SEQ ID NO: 169433 - RNA, 1410 nt, Artificial Sequence; identical to SEQ ID NO: 169248
  derived and/or modified sequence opt4 from neuraminidase__InfluenzaA__ACR49279

SEQ ID NO: 169434 - RNA, 1410 nt, Artificial Sequence; identical to SEQ ID NO: 169248
  derived and/or modified sequence opt4 from neuraminidase__InfluenzaA__ACR50994

SEQ ID NO: 169435 - RNA, 1410 nt, Artificial Sequence; identical to SEQ ID NO: 169258
  derived and/or modified sequence opt4 from neuraminidase__InfluenzaA__ACR50998

SEQ ID NO: 169436 - RNA, 1410 nt, Artificial Sequence; identical to SEQ ID NO: 169258
  derived and/or modified sequence opt4 from neuraminidase__InfluenzaA__ACR51008

SEQ ID NO: 169437 - RNA, 1410 nt, Artificial Sequence; identical to SEQ ID NO: 169258
  derived and/or modified sequence opt4 from neuraminidase__InfluenzaA__ACR51018

SEQ ID NO: 169438 - RNA, 1410 nt, Artificial Sequence; identical to SEQ ID NO: 169258
  derived and/or modified sequence opt4 from neuraminidase__InfluenzaA__ACR51028

SEQ ID NO: 169439 - RNA, 1410 nt, Artificial Sequence
  derived and/or modified sequence opt4 from neuraminidase__InfluenzaA__ACR51038
augaaccccaaccagaagaucaucaccaucggcagcgugugcaugagcaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169440 - RNA, 1410 nt, Artificial Sequence; identical to SEQ ID NO: 169258
  derived and/or modified sequence opt4 from neuraminidase__InfluenzaA__ACR51048

SEQ ID NO: 169441 - RNA, 1410 nt, Artificial Sequence; identical to SEQ ID NO: 169258
  derived and/or modified sequence opt4 from neuraminidase__InfluenzaA__ACR51058

SEQ ID NO: 169442 - RNA, 1410 nt, Artificial Sequence; identical to SEQ ID NO: 169248
  derived and/or modified sequence opt4 from neuraminidase__InfluenzaA__ACR51068

SEQ ID NO: 169443 - RNA, 1410 nt, Artificial Sequence; identical to SEQ ID NO: 169258
  derived and/or modified sequence opt4 from neuraminidase__InfluenzaA__ACR52371

SEQ ID NO: 169444 - RNA, 1410 nt, Artificial Sequence; identical to SEQ ID NO: 169258
  derived and/or modified sequence opt4 from neuraminidase__InfluenzaA__ACR52381

SEQ ID NO: 169445 - RNA, 1410 nt, Artificial Sequence; identical to SEQ ID NO: 169258
  derived and/or modified sequence opt4 from neuraminidase__InfluenzaA__ACR52391

SEQ ID NO: 169446 - RNA, 1410 nt, Artificial Sequence; identical to SEQ ID NO: 169258
  derived and/or modified sequence opt4 from neuraminidase__InfluenzaA__ACR52401

SEQ ID NO: 169447 - RNA, 1410 nt, Artificial Sequence; identical to SEQ ID NO: 169258
  derived and/or modified sequence opt4 from neuraminidase__InfluenzaA__ACR52411

SEQ ID NO: 169448 - RNA, 1410 nt, Artificial Sequence; identical to SEQ ID NO: 169258
  derived and/or modified sequence opt4 from neuraminidase__InfluenzaA__ACR52421

SEQ ID NO: 169449 - RNA, 1410 nt, Artificial Sequence; identical to SEQ ID NO: 169258
  derived and/or modified sequence opt4 from neuraminidase__InfluenzaA__ACR52431

SEQ ID NO: 169450 - RNA, 1410 nt, Artificial Sequence; identical to SEQ ID NO: 169258
  derived and/or modified sequence opt4 from neuraminidase__InfluenzaA__ACR52441

SEQ ID NO: 169451 - RNA, 1410 nt, Artificial Sequence; identical to SEQ ID NO: 169258
  derived and/or modified sequence opt4 from neuraminidase__InfluenzaA__ACR52451

SEQ ID NO: 169452 - RNA, 1410 nt, Artificial Sequence; identical to SEQ ID NO: 169258
  derived and/or modified sequence opt4 from neuraminidase__InfluenzaA__ACR52471

SEQ ID NO: 169453 - RNA, 1410 nt, Artificial Sequence; identical to SEQ ID NO: 169258
  derived and/or modified sequence opt4 from neuraminidase__InfluenzaA__ACR52481

SEQ ID NO: 169454 - RNA, 1410 nt, Artificial Sequence; identical to SEQ ID NO: 169258
  derived and/or modified sequence opt4 from neuraminidase__InfluenzaA__ACR52491

SEQ ID NO: 169455 - RNA, 1410 nt, Artificial Sequence; identical to SEQ ID NO: 169258
  derived and/or modified sequence opt4 from neuraminidase__InfluenzaA__ACR54046

SEQ ID NO: 169456 - RNA, 1410 nt, Artificial Sequence; identical to SEQ ID NO: 169248
  derived and/or modified sequence opt4 from neuraminidase__InfluenzaA__ACR54052

SEQ ID NO: 169457 - RNA, 1410 nt, Artificial Sequence; identical to SEQ ID NO: 169258
  derived and/or modified sequence opt4 from neuraminidase__InfluenzaA__ACR54966

SEQ ID NO: 169458 - RNA, 1410 nt, Artificial Sequence; identical to SEQ ID NO: 169258
  derived and/or modified sequence opt4 from neuraminidase__InfluenzaA__ACR54976

SEQ ID NO: 169459 - RNA, 1410 nt, Artificial Sequence; identical to SEQ ID NO: 169258
  derived and/or modified sequence opt4 from neuraminidase__InfluenzaA__ACR54986

SEQ ID NO: 169460 - RNA, 1410 nt, Artificial Sequence; identical to SEQ ID NO: 169248
  derived and/or modified sequence opt4 from neuraminidase__InfluenzaA__ACR54996

SEQ ID NO: 169461 - RNA, 1410 nt, Artificial Sequence; identical to SEQ ID NO: 169258
  derived and/or modified sequence opt4 from neuraminidase__InfluenzaA__ACR55006

SEQ ID NO: 169462 - RNA, 1410 nt, Artificial Sequence; identical to SEQ ID NO: 169248
  derived and/or modified sequence opt4 from neuraminidase__InfluenzaA__ACR56383

SEQ ID NO: 169463 - RNA, 1410 nt, Artificial Sequence; identical to SEQ ID NO: 169248
  derived and/or modified sequence opt4 from neuraminidase__InfluenzaA__ACR56393

SEQ ID NO: 169464 - RNA, 1410 nt, Artificial Sequence; identical to SEQ ID NO: 169258
  derived and/or modified sequence opt4 from neuraminidase__InfluenzaA__ACR56403

SEQ ID NO: 169465 - RNA, 1410 nt, Artificial Sequence; identical to SEQ ID NO: 169258
  derived and/or modified sequence opt4 from neuraminidase__InfluenzaA__ACR56413

SEQ ID NO: 169466 - RNA, 1410 nt, Artificial Sequence; identical to SEQ ID NO: 169258
  derived and/or modified sequence opt4 from neuraminidase__InfluenzaA__ACR56423

SEQ ID NO: 169467 - RNA, 1410 nt, Artificial Sequence; identical to SEQ ID NO: 169258
  derived and/or modified sequence opt4 from neuraminidase__InfluenzaA__ACR56433

SEQ ID NO: 169468 - RNA, 1410 nt, Artificial Sequence; identical to SEQ ID NO: 169258
  derived and/or modified sequence opt4 from neuraminidase__InfluenzaA__ACR56443

SEQ ID NO: 169469 - RNA, 1410 nt, Artificial Sequence; identical to SEQ ID NO: 169258
  derived and/or modified sequence opt4 from neuraminidase__InfluenzaA__ACR56453

SEQ ID NO: 169470 - RNA, 1413 nt, Artificial Sequence; identical to SEQ ID NO: 169236
  derived and/or modified sequence opt4 from neuraminidase__InfluenzaA__ACR58555

SEQ ID NO: 169471 - RNA, 1413 nt, Artificial Sequence
  derived and/or modified sequence opt4 from neuraminidase__InfluenzaA__ACR61658
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacguggugaccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 169472 - RNA, 1410 nt, Artificial Sequence
  derived and/or modified sequence opt4 from neuraminidase__InfluenzaA__ACR61680
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaucguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169473 - RNA, 1410 nt, Artificial Sequence
  derived and/or modified sequence opt4 from neuraminidase__InfluenzaA__ACR61691
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccacaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169474 - RNA, 1410 nt, Artificial Sequence
  derived and/or modified sequence opt4 from neuraminidase__InfluenzaA__ACR61702
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagcaacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169475 - RNA, 1410 nt, Artificial Sequence; identical to SEQ ID NO: 169248
  derived and/or modified sequence opt4 from neuraminidase__InfluenzaA__ACR67201

SEQ ID NO: 169476 - RNA, 1410 nt, Artificial Sequence; identical to SEQ ID NO: 169258
  derived and/or modified sequence opt4 from neuraminidase__InfluenzaA__ACR67202

SEQ ID NO: 169477 - RNA, 1410 nt, Artificial Sequence; identical to SEQ ID NO: 169248
  derived and/or modified sequence opt4 from neuraminidase__InfluenzaA__ACR67203

SEQ ID NO: 169478 - RNA, 1410 nt, Artificial Sequence; identical to SEQ ID NO: 169258
  derived and/or modified sequence opt4 from neuraminidase__InfluenzaA__ACR67204

SEQ ID NO: 169479 - RNA, 1410 nt, Artificial Sequence; identical to SEQ ID NO: 169258
  derived and/or modified sequence opt4 from neuraminidase__InfluenzaA__ACR67246

SEQ ID NO: 169480 - RNA, 1410 nt, Artificial Sequence; identical to SEQ ID NO: 169248
  derived and/or modified sequence opt4 from neuraminidase__InfluenzaA__ACR67256

SEQ ID NO: 169481 - RNA, 1410 nt, Artificial Sequence; identical to SEQ ID NO: 169258
  derived and/or modified sequence opt4 from neuraminidase__InfluenzaA__ACR77451

SEQ ID NO: 169482 - RNA, 1410 nt, Artificial Sequence; identical to SEQ ID NO: 169258
  derived and/or modified sequence opt4 from neuraminidase__InfluenzaA__ACR77461

SEQ ID NO: 169483 - RNA, 1410 nt, Artificial Sequence; identical to SEQ ID NO: 169258
  derived and/or modified sequence opt4 from neuraminidase__InfluenzaA__ACR77471

SEQ ID NO: 169484 - RNA, 1410 nt, Artificial Sequence; identical to SEQ ID NO: 169258
  derived and/or modified sequence opt4 from neuraminidase__InfluenzaA__ACR77481

SEQ ID NO: 169485 - RNA, 1410 nt, Artificial Sequence; identical to SEQ ID NO: 169258
  derived and/or modified sequence opt4 from neuraminidase__InfluenzaA__ACR77491

SEQ ID NO: 169486 - RNA, 1410 nt, Artificial Sequence; identical to SEQ ID NO: 169258
  derived and/or modified sequence opt4 from neuraminidase__InfluenzaA__ACR77501

SEQ ID NO: 169487 - RNA, 1410 nt, Artificial Sequence; identical to SEQ ID NO: 169258
  derived and/or modified sequence opt4 from neuraminidase__InfluenzaA__ACR83527

SEQ ID NO: 169488 - RNA, 1410 nt, Artificial Sequence; identical to SEQ ID NO: 169258
  derived and/or modified sequence opt4 from neuraminidase__InfluenzaA__ACR83539

SEQ ID NO: 169489 - RNA, 1410 nt, Artificial Sequence; identical to SEQ ID NO: 169258
  derived and/or modified sequence opt4 from neuraminidase__InfluenzaA__ACS14669

SEQ ID NO: 169490 - RNA, 1410 nt, Artificial Sequence; identical to SEQ ID NO: 169258
  derived and/or modified sequence opt4 from neuraminidase__InfluenzaA__ACS14679

SEQ ID NO: 169491 - RNA, 1410 nt, Artificial Sequence; identical to SEQ ID NO: 169258
  derived and/or modified sequence opt4 from neuraminidase__InfluenzaA__ACS14689

SEQ ID NO: 169492 - RNA, 1410 nt, Artificial Sequence; identical to SEQ ID NO: 169258
  derived and/or modified sequence opt4 from neuraminidase__InfluenzaA__ACS14699

SEQ ID NO: 169493 - RNA, 1410 nt, Artificial Sequence; identical to SEQ ID NO: 169258
  derived and/or modified sequence opt4 from neuraminidase__InfluenzaA__ACS14709

SEQ ID NO: 169494 - RNA, 1410 nt, Artificial Sequence; identical to SEQ ID NO: 169258
  derived and/or modified sequence opt4 from neuraminidase__InfluenzaA__ACS14719

SEQ ID NO: 169495 - RNA, 1410 nt, Artificial Sequence; identical to SEQ ID NO: 169258
  derived and/or modified sequence opt4 from neuraminidase__InfluenzaA__ACS14729

SEQ ID NO: 169496 - RNA, 1410 nt, Artificial Sequence; identical to SEQ ID NO: 169258
  derived and/or modified sequence opt4 from neuraminidase__InfluenzaA__ACS14739

SEQ ID NO: 169497 - RNA, 1410 nt, Artificial Sequence; identical to SEQ ID NO: 169248
  derived and/or modified sequence opt4 from neuraminidase__InfluenzaA__ACS27192

SEQ ID NO: 169498 - RNA, 1410 nt, Artificial Sequence; identical to SEQ ID NO: 169258
  derived and/or modified sequence opt4 from neuraminidase__InfluenzaA__ACS27202

SEQ ID NO: 169499 - RNA, 1410 nt, Artificial Sequence; identical to SEQ ID NO: 169258
  derived and/or modified sequence opt4 from neuraminidase__InfluenzaA__ACS27212

SEQ ID NO: 169500 - RNA, 1410 nt, Artificial Sequence; identical to SEQ ID NO: 169248
  derived and/or modified sequence opt4 from neuraminidase__InfluenzaA__ACS27222

SEQ ID NO: 169501 - RNA, 1410 nt, Artificial Sequence; identical to SEQ ID NO: 169258
  derived and/or modified sequence opt4 from neuraminidase__InfluenzaA__ACS27232

SEQ ID NO: 169502 - RNA, 1410 nt, Artificial Sequence; identical to SEQ ID NO: 169248
  derived and/or modified sequence opt4 from neuraminidase__InfluenzaA__ACS27242

SEQ ID NO: 169503 - RNA, 1410 nt, Artificial Sequence; identical to SEQ ID NO: 169258
  derived and/or modified sequence opt4 from neuraminidase__InfluenzaA__ACS27252

SEQ ID NO: 169504 - RNA, 1410 nt, Artificial Sequence; identical to SEQ ID NO: 169248
  derived and/or modified sequence opt4 from neuraminidase__InfluenzaA__ACS27771

SEQ ID NO: 169505 - RNA, 1410 nt, Artificial Sequence; identical to SEQ ID NO: 169413
  derived and/or modified sequence opt4 from neuraminidase__InfluenzaA__ACS34969

SEQ ID NO: 169506 - RNA, 1410 nt, Artificial Sequence; identical to SEQ ID NO: 169413
  derived and/or modified sequence opt4 from neuraminidase__InfluenzaA__ACS34970

SEQ ID NO: 169507 - RNA, 1410 nt, Artificial Sequence; identical to SEQ ID NO: 169413
  derived and/or modified sequence opt4 from neuraminidase__InfluenzaA__ACS34971

SEQ ID NO: 169508 - RNA, 1410 nt, Artificial Sequence; identical to SEQ ID NO: 169258
  derived and/or modified sequence opt4 from neuraminidase__InfluenzaA__ACS34972

SEQ ID NO: 169509 - RNA, 1410 nt, Artificial Sequence; identical to SEQ ID NO: 169258
  derived and/or modified sequence opt4 from neuraminidase__InfluenzaA__ACS50081

SEQ ID NO: 169510 - RNA, 1410 nt, Artificial Sequence; identical to SEQ ID NO: 169258
  derived and/or modified sequence opt4 from neuraminidase__InfluenzaA__ACS50087

SEQ ID NO: 169511 - RNA, 1410 nt, Artificial Sequence; identical to SEQ ID NO: 169258
  derived and/or modified sequence opt4 from neuraminidase__InfluenzaA__ACS50094

SEQ ID NO: 169512 - RNA, 1410 nt, Artificial Sequence; identical to SEQ ID NO: 169248
  derived and/or modified sequence opt4 from neuraminidase__InfluenzaA__ACS54264

SEQ ID NO: 169513 - RNA, 1410 nt, Artificial Sequence; identical to SEQ ID NO: 169413
  derived and/or modified sequence opt4 from neuraminidase__InfluenzaA__ACS54265

SEQ ID NO: 169514 - RNA, 1410 nt, Artificial Sequence; identical to SEQ ID NO: 169258
  derived and/or modified sequence opt4 from neuraminidase__InfluenzaA__ACS54266

SEQ ID NO: 169515 - RNA, 1410 nt, Artificial Sequence; identical to SEQ ID NO: 169258
  derived and/or modified sequence opt4 from neuraminidase__InfluenzaA__ACS54267

SEQ ID NO: 169516 - RNA, 1410 nt, Artificial Sequence; identical to SEQ ID NO: 169258
  derived and/or modified sequence opt4 from neuraminidase__InfluenzaA__ACS54268

SEQ ID NO: 169517 - RNA, 1410 nt, Artificial Sequence; identical to SEQ ID NO: 169258
  derived and/or modified sequence opt4 from neuraminidase__InfluenzaA__ACS54303

SEQ ID NO: 169518 - RNA, 1410 nt, Artificial Sequence; identical to SEQ ID NO: 169258
  derived and/or modified sequence opt4 from neuraminidase__InfluenzaA__ACS68823

SEQ ID NO: 169519 - RNA, 1410 nt, Artificial Sequence; identical to SEQ ID NO: 169258
  derived and/or modified sequence opt4 from neuraminidase__InfluenzaA__ACS75824

SEQ ID NO: 169520 - RNA, 1410 nt, Artificial Sequence; identical to SEQ ID NO: 169258
  derived and/or modified sequence opt4 from neuraminidase__InfluenzaA__ACS77929

SEQ ID NO: 169521 - RNA, 1410 nt, Artificial Sequence; identical to SEQ ID NO: 169258
  derived and/or modified sequence opt4 from neuraminidase__InfluenzaA__ACS77939

SEQ ID NO: 169522 - RNA, 1410 nt, Artificial Sequence; identical to SEQ ID NO: 169248
  derived and/or modified sequence opt4 from neuraminidase__InfluenzaA__ACS77949

SEQ ID NO: 169523 - RNA, 1410 nt, Artificial Sequence; identical to SEQ ID NO: 169258
  derived and/or modified sequence opt4 from neuraminidase__InfluenzaA__ACS77959

SEQ ID NO: 169524 - RNA, 1410 nt, Artificial Sequence; identical to SEQ ID NO: 169258
  derived and/or modified sequence opt4 from neuraminidase__InfluenzaA__ACS77969

SEQ ID NO: 169525 - RNA, 1410 nt, Artificial Sequence; identical to SEQ ID NO: 169258
  derived and/or modified sequence opt4 from neuraminidase__InfluenzaA__ACS77979

SEQ ID NO: 169526 - RNA, 1410 nt, Artificial Sequence; identical to SEQ ID NO: 169258
  derived and/or modified sequence opt4 from neuraminidase__InfluenzaA__ACS77989

SEQ ID NO: 169527 - RNA, 1410 nt, Artificial Sequence; identical to SEQ ID NO: 169258
  derived and/or modified sequence opt4 from neuraminidase__InfluenzaA__ACS77999

SEQ ID NO: 169528 - RNA, 1410 nt, Artificial Sequence; identical to SEQ ID NO: 169258
  derived and/or modified sequence opt4 from neuraminidase__InfluenzaA__ACS78009

SEQ ID NO: 169529 - RNA, 1410 nt, Artificial Sequence; identical to SEQ ID NO: 169258
  derived and/or modified sequence opt4 from neuraminidase__InfluenzaA__ACS78019

SEQ ID NO: 169530 - RNA, 1410 nt, Artificial Sequence; identical to SEQ ID NO: 169258
  derived and/or modified sequence opt4 from neuraminidase__InfluenzaA__ACS78039

SEQ ID NO: 169531 - RNA, 1410 nt, Artificial Sequence; identical to SEQ ID NO: 169258
  derived and/or modified sequence opt4 from neuraminidase__InfluenzaA__ACS78049

SEQ ID NO: 169532 - RNA, 1410 nt, Artificial Sequence; identical to SEQ ID NO: 169258
  derived and/or modified sequence opt4 from neuraminidase__InfluenzaA__ACS88274

SEQ ID NO: 169533 - RNA, 1410 nt, Artificial Sequence; identical to SEQ ID NO: 169258
  derived and/or modified sequence opt4 from neuraminidase__InfluenzaA__ACS88275

SEQ ID NO: 169534 - RNA, 1410 nt, Artificial Sequence; identical to SEQ ID NO: 169248
  derived and/or modified sequence opt4 from neuraminidase__InfluenzaA__ACS92572

SEQ ID NO: 169535 - RNA, 1410 nt, Artificial Sequence; identical to SEQ ID NO: 169248
  derived and/or modified sequence opt4 from neuraminidase__InfluenzaA__ACS92582

SEQ ID NO: 169536 - RNA, 1410 nt, Artificial Sequence; identical to SEQ ID NO: 169258
  derived and/or modified sequence opt4 from neuraminidase__InfluenzaA__ACS92592

SEQ ID NO: 169537 - RNA, 1410 nt, Artificial Sequence; identical to SEQ ID NO: 169258
  derived and/or modified sequence opt4 from neuraminidase__InfluenzaA__ACS92603

SEQ ID NO: 169538 - RNA, 1410 nt, Artificial Sequence; identical to SEQ ID NO: 169248
  derived and/or modified sequence opt4 from neuraminidase__InfluenzaA__ACS92614

SEQ ID NO: 169539 - RNA, 1410 nt, Artificial Sequence; identical to SEQ ID NO: 169258
  derived and/or modified sequence opt4 from neuraminidase__InfluenzaA__ACT09115

SEQ ID NO: 169540 - RNA, 1410 nt, Artificial Sequence; identical to SEQ ID NO: 169258
  derived and/or modified sequence opt4 from neuraminidase__InfluenzaA__ACT10309

SEQ ID NO: 169541 - RNA, 1410 nt, Artificial Sequence; identical to SEQ ID NO: 169258
  derived and/or modified sequence opt4 from neuraminidase__InfluenzaA__ACT10315

SEQ ID NO: 169542 - RNA, 1410 nt, Artificial Sequence; identical to SEQ ID NO: 169248
  derived and/or modified sequence opt4 from neuraminidase__InfluenzaA__ACT11059

SEQ ID NO: 169543 - RNA, 1350 nt, Artificial Sequence
  derived and/or modified sequence opt4 from neuraminidase__InfluenzaA__ACT15313
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 169544 - RNA, 1350 nt, Artificial Sequence
  derived and/or modified sequence opt4 from neuraminidase__InfluenzaA__ACT15315
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaugagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 169545 - RNA, 1350 nt, Artificial Sequence; identical to SEQ ID NO: 169543
  derived and/or modified sequence opt4 from neuraminidase__InfluenzaA__ACT15319

SEQ ID NO: 169546 - RNA, 1350 nt, Artificial Sequence
  derived and/or modified sequence opt4 from neuraminidase__InfluenzaA__ACT15321
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagagagccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 169547 - RNA, 1350 nt, Artificial Sequence; identical to SEQ ID NO: 169543
  derived and/or modified sequence opt4 from neuraminidase__InfluenzaA__ACT15323

SEQ ID NO: 169548 - RNA, 1350 nt, Artificial Sequence; identical to SEQ ID NO: 169543
  derived and/or modified sequence opt4 from neuraminidase__InfluenzaA__ACT15325

SEQ ID NO: 169549 - RNA, 1350 nt, Artificial Sequence
  derived and/or modified sequence opt4 from neuraminidase__InfluenzaA__ACT15327
augaaccccaaccagaagaucaucaccaucggcagcaucugcauggugaucggcaucgugagccugaugcugcagaucggcaacaugaucagcaucugggugagccacagcauccagaccggcaacagaugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguacaagaucggcuacaucugcagcggcaucuucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 169550 - RNA, 1350 nt, Artificial Sequence
  derived and/or modified sequence opt4 from neuraminidase__InfluenzaA__ACT15331
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 169551 - RNA, 1350 nt, Artificial Sequence
  derived and/or modified sequence opt4 from neuraminidase__InfluenzaA__ACT15333
augaaccccaaccagaagaucaucaccaucggcagcaucugcauggugaucggcaucgugagccugaugcugcagaucggcaacaugaucagcaucugggugagccacagcauccagaccggcaaccagugccagggcgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguggugagcaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcggcaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 169552 - RNA, 1350 nt, Artificial Sequence
  derived and/or modified sequence opt4 from neuraminidase__InfluenzaA__ACT15335
augaaccccaaccagaagaucaucaccaucggcagcaucugcauggugaucggcaucgugagccugaugcugcagaucggcaacaugaucagcaucugggugagccacagcauccagaccggcaacagaugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguacaagaucggcuacaucugcagcggcaucuucggcgacaaccccagacccaacgacggcaccggcagcugcggccccgugcugcccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 169553 - RNA, 1350 nt, Artificial Sequence
  derived and/or modified sequence opt4 from neuraminidase__InfluenzaA__ACT15337
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccgugaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 169554 - RNA, 1350 nt, Artificial Sequence; identical to SEQ ID NO: 169543
  derived and/or modified sequence opt4 from neuraminidase__InfluenzaA__ACT15341

SEQ ID NO: 169555 - RNA, 1350 nt, Artificial Sequence
  derived and/or modified sequence opt4 from neuraminidase__InfluenzaA__ACT15344
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaagcaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 169556 - RNA, 1350 nt, Artificial Sequence
  derived and/or modified sequence opt4 from neuraminidase__InfluenzaA__ACT15346
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacaacaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 169557 - RNA, 1350 nt, Artificial Sequence
  derived and/or modified sequence opt4 from neuraminidase__InfluenzaA__ACT15348
augaaccccaaccagaagaucaucaccaucggcagcaucugcauggugaucggcaccgugagccugaugcugcagaucggcaacaugaucagcaucugggugagccacagcauccagaccggcaaccagugccagggcgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguggugagcaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcggcaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 169558 - RNA, 1350 nt, Artificial Sequence
  derived and/or modified sequence opt4 from neuraminidase__InfluenzaA__ACT15350
augaaccccaaccagaagaucaucaccaucggcagcaucugcauggugaucggcaucgugagccugaugcugcagaucggcaacaugaucagcaucugggugagccacagcauccagaccggcaacagaugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguacaagaucggcuacaucugcagcggcaucuucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagaaccaucuggaccagcggcagcagcaucagcuucugcggcgugaacggcgacaccgugagcuggagcuggcccgacggcgccgagcugcccuucaccaucgacaaguga

SEQ ID NO: 169559 - RNA, 1350 nt, Artificial Sequence
  derived and/or modified sequence opt4 from neuraminidase__InfluenzaA__ACT15352
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguggugagcaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcggcaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 169560 - RNA, 1350 nt, Artificial Sequence
  derived and/or modified sequence opt4 from neuraminidase__InfluenzaA__ACT15354
augaaccccagccagaagaucaucaccaucggcagcaucugcauggugaucggcaucgugagccugaugcugcagaucggcaacaugaucagcaucuggaucagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 169561 - RNA, 1350 nt, Artificial Sequence
  derived and/or modified sequence opt4 from neuraminidase__InfluenzaA__ACT15356
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguucagcaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcggcaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 169562 - RNA, 1350 nt, Artificial Sequence
  derived and/or modified sequence opt4 from neuraminidase__InfluenzaA__ACT15358
augaaccccaaccagaagaucaucaccaucggcagcaucugcauggugaucggcaucgugagccugaugcugcagaucggcaacaugaucagcaucugggugagccacagcauccagaccggcaacagaugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccacggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccuggaucagcuucaaccagaaccuggaguacaagaucggcuacaucugcagcggcaucuucggcgacaaccccagacccaacgacggcaccggcagcugcggccccgugcugcccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 169563 - RNA, 1410 nt, Artificial Sequence; identical to SEQ ID NO: 166847
  derived and/or modified sequence opt4 from neuraminidase__InfluenzaA__ACT21515

SEQ ID NO: 169564 - RNA, 1410 nt, Artificial Sequence
  derived and/or modified sequence opt4 from neuraminidase__InfluenzaA__ACT21516
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucgccuaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcguggccuggagcagcagcagcugccacgacggcaaggccuggcugcacgugugcgugaccggcgacgagaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 169565 - RNA, 1410 nt, Artificial Sequence
  derived and/or modified sequence opt4 from neuraminidase__InfluenzaA__ACT21517
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcgagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccuggugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggccggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169566 - RNA, 1410 nt, Artificial Sequence; identical to SEQ ID NO: 169258
  derived and/or modified sequence opt4 from neuraminidase__InfluenzaA__ACT21574

SEQ ID NO: 169567 - RNA, 1410 nt, Artificial Sequence; identical to SEQ ID NO: 169258
  derived and/or modified sequence opt4 from neuraminidase__InfluenzaA__ACT21585

SEQ ID NO: 169568 - RNA, 1410 nt, Artificial Sequence; identical to SEQ ID NO: 169258
  derived and/or modified sequence opt4 from neuraminidase__InfluenzaA__ACT22011

SEQ ID NO: 169569 - RNA, 1410 nt, Artificial Sequence; identical to SEQ ID NO: 169258
  derived and/or modified sequence opt4 from neuraminidase__InfluenzaA__ACT22012

SEQ ID NO: 169570 - RNA, 1410 nt, Artificial Sequence; identical to SEQ ID NO: 169258
  derived and/or modified sequence opt4 from neuraminidase__InfluenzaA__ACT22013

SEQ ID NO: 169571 - RNA, 1410 nt, Artificial Sequence; identical to SEQ ID NO: 169258
  derived and/or modified sequence opt4 from neuraminidase__InfluenzaA__ACT22014

SEQ ID NO: 169572 - RNA, 1410 nt, Artificial Sequence; identical to SEQ ID NO: 169248
  derived and/or modified sequence opt4 from neuraminidase__InfluenzaA__ACT22015

SEQ ID NO: 169573 - RNA, 1410 nt, Artificial Sequence
  derived and/or modified sequence opt4 from neuraminidase__InfluenzaA__ACT22016
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169574 - RNA, 1410 nt, Artificial Sequence; identical to SEQ ID NO: 169258
  derived and/or modified sequence opt4 from neuraminidase__InfluenzaA__ACT22017

SEQ ID NO: 169575 - RNA, 1410 nt, Artificial Sequence; identical to SEQ ID NO: 169258
  derived and/or modified sequence opt4 from neuraminidase__InfluenzaA__ACT22018

SEQ ID NO: 169576 - RNA, 1410 nt, Artificial Sequence; identical to SEQ ID NO: 169248
  derived and/or modified sequence opt4 from neuraminidase__InfluenzaA__ACT22506

SEQ ID NO: 169577 - RNA, 1410 nt, Artificial Sequence; identical to SEQ ID NO: 169258
  derived and/or modified sequence opt4 from neuraminidase__InfluenzaA__ACT22511

SEQ ID NO: 169578 - RNA, 1410 nt, Artificial Sequence; identical to SEQ ID NO: 169258
  derived and/or modified sequence opt4 from neuraminidase__InfluenzaA__ACT33121

SEQ ID NO: 169579 - RNA, 1410 nt, Artificial Sequence; identical to SEQ ID NO: 169258
  derived and/or modified sequence opt4 from neuraminidase__InfluenzaA__ACT33124

SEQ ID NO: 169580 - RNA, 1410 nt, Artificial Sequence; identical to SEQ ID NO: 169258
  derived and/or modified sequence opt4 from neuraminidase__InfluenzaA__ACT33126

SEQ ID NO: 169581 - RNA, 1410 nt, Artificial Sequence; identical to SEQ ID NO: 169248
  derived and/or modified sequence opt4 from neuraminidase__InfluenzaA__ACT35526

SEQ ID NO: 169582 - RNA, 1410 nt, Artificial Sequence; identical to SEQ ID NO: 169258
  derived and/or modified sequence opt4 from neuraminidase__InfluenzaA__ACT36507

SEQ ID NO: 169583 - RNA, 1410 nt, Artificial Sequence; identical to SEQ ID NO: 169258
  derived and/or modified sequence opt4 from neuraminidase__InfluenzaA__ACT36672

SEQ ID NO: 169584 - RNA, 1410 nt, Artificial Sequence; identical to SEQ ID NO: 169258
  derived and/or modified sequence opt4 from neuraminidase__InfluenzaA__ACT36673

SEQ ID NO: 169585 - RNA, 1410 nt, Artificial Sequence; identical to SEQ ID NO: 169258
  derived and/or modified sequence opt4 from neuraminidase__InfluenzaA__ACT36674

SEQ ID NO: 169586 - RNA, 1410 nt, Artificial Sequence; identical to SEQ ID NO: 169258
  derived and/or modified sequence opt4 from neuraminidase__InfluenzaA__ACT36675

SEQ ID NO: 169587 - RNA, 1410 nt, Artificial Sequence; identical to SEQ ID NO: 169258
  derived and/or modified sequence opt4 from neuraminidase__InfluenzaA__ACT36677

SEQ ID NO: 169588 - RNA, 1410 nt, Artificial Sequence
  derived and/or modified sequence opt4 from neuraminidase__InfluenzaA__ACT36678
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccagacagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169589 - RNA, 1410 nt, Artificial Sequence; identical to SEQ ID NO: 169248
  derived and/or modified sequence opt4 from neuraminidase__InfluenzaA__ACT36679

SEQ ID NO: 169590 - RNA, 1410 nt, Artificial Sequence; identical to SEQ ID NO: 169258
  derived and/or modified sequence opt4 from neuraminidase__InfluenzaA__ACT36680

SEQ ID NO: 169591 - RNA, 1410 nt, Artificial Sequence; identical to SEQ ID NO: 169248
  derived and/or modified sequence opt4 from neuraminidase__InfluenzaA__ACT36682

SEQ ID NO: 169592 - RNA, 1410 nt, Artificial Sequence; identical to SEQ ID NO: 169248
  derived and/or modified sequence opt4 from neuraminidase__InfluenzaA__ACT36683

SEQ ID NO: 169593 - RNA, 1410 nt, Artificial Sequence; identical to SEQ ID NO: 169258
  derived and/or modified sequence opt4 from neuraminidase__InfluenzaA__ACT36684

SEQ ID NO: 169594 - RNA, 1410 nt, Artificial Sequence; identical to SEQ ID NO: 169248
  derived and/or modified sequence opt4 from neuraminidase__InfluenzaA__ACT36685

SEQ ID NO: 169595 - RNA, 1410 nt, Artificial Sequence; identical to SEQ ID NO: 169248
  derived and/or modified sequence opt4 from neuraminidase__InfluenzaA__ACT36686

SEQ ID NO: 169596 - RNA, 1410 nt, Artificial Sequence; identical to SEQ ID NO: 169248
  derived and/or modified sequence opt4 from neuraminidase__InfluenzaA__ACT36687

SEQ ID NO: 169597 - RNA, 1410 nt, Artificial Sequence
  derived and/or modified sequence opt4 from neuraminidase__InfluenzaA__ACT36688
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuacaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169598 - RNA, 1410 nt, Artificial Sequence; identical to SEQ ID NO: 169248
  derived and/or modified sequence opt4 from neuraminidase__InfluenzaA__ACT36689

SEQ ID NO: 169599 - RNA, 1410 nt, Artificial Sequence; identical to SEQ ID NO: 169288
  derived and/or modified sequence opt4 from neuraminidase__InfluenzaA__ACT36690

SEQ ID NO: 169600 - RNA, 1410 nt, Artificial Sequence; identical to SEQ ID NO: 169248
  derived and/or modified sequence opt4 from neuraminidase__InfluenzaA__ACT36691

SEQ ID NO: 169601 - RNA, 1410 nt, Artificial Sequence; identical to SEQ ID NO: 169288
  derived and/or modified sequence opt4 from neuraminidase__InfluenzaA__ACT36693

SEQ ID NO: 169602 - RNA, 1410 nt, Artificial Sequence; identical to SEQ ID NO: 169258
  derived and/or modified sequence opt4 from neuraminidase__InfluenzaA__ACT36694

SEQ ID NO: 169603 - RNA, 1410 nt, Artificial Sequence; identical to SEQ ID NO: 169258
  derived and/or modified sequence opt4 from neuraminidase__InfluenzaA__ACT36695

SEQ ID NO: 169604 - RNA, 1410 nt, Artificial Sequence; identical to SEQ ID NO: 169258
  derived and/or modified sequence opt4 from neuraminidase__InfluenzaA__ACT52684

SEQ ID NO: 169605 - RNA, 1410 nt, Artificial Sequence; identical to SEQ ID NO: 169248
  derived and/or modified sequence opt4 from neuraminidase__InfluenzaA__ACT54608

SEQ ID NO: 169606 - RNA, 1410 nt, Artificial Sequence
  derived and/or modified sequence opt4 from neuraminidase__InfluenzaA__ACT66157
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagauccugagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169607 - RNA, 1410 nt, Artificial Sequence; identical to SEQ ID NO: 169258
  derived and/or modified sequence opt4 from neuraminidase__InfluenzaA__ACT67117

SEQ ID NO: 169608 - RNA, 1410 nt, Artificial Sequence; identical to SEQ ID NO: 169248
  derived and/or modified sequence opt4 from neuraminidase__InfluenzaA__ACT67121

SEQ ID NO: 169609 - RNA, 1410 nt, Artificial Sequence; identical to SEQ ID NO: 169258
  derived and/or modified sequence opt4 from neuraminidase__InfluenzaA__ACT67240

SEQ ID NO: 169610 - RNA, 1410 nt, Artificial Sequence; identical to SEQ ID NO: 169258
  derived and/or modified sequence opt4 from neuraminidase__InfluenzaA__ACT67241

SEQ ID NO: 169611 - RNA, 1410 nt, Artificial Sequence; identical to SEQ ID NO: 169258
  derived and/or modified sequence opt4 from neuraminidase__InfluenzaA__ACT67243

SEQ ID NO: 169612 - RNA, 1410 nt, Artificial Sequence
  derived and/or modified sequence opt4 from neuraminidase__InfluenzaA__ACT67256
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169613 - RNA, 1410 nt, Artificial Sequence
  derived and/or modified sequence opt4 from neuraminidase__InfluenzaA__ACT68161
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaaggccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169614 - RNA, 1410 nt, Artificial Sequence; identical to SEQ ID NO: 169248
  derived and/or modified sequence opt4 from neuraminidase__InfluenzaA__ACT68162

SEQ ID NO: 169615 - RNA, 1410 nt, Artificial Sequence; identical to SEQ ID NO: 169248
  derived and/or modified sequence opt4 from neuraminidase__InfluenzaA__ACT68163

SEQ ID NO: 169616 - RNA, 1410 nt, Artificial Sequence; identical to SEQ ID NO: 169248
  derived and/or modified sequence opt4 from neuraminidase__InfluenzaA__ACT68164

SEQ ID NO: 169617 - RNA, 1410 nt, Artificial Sequence; identical to SEQ ID NO: 169258
  derived and/or modified sequence opt4 from neuraminidase__InfluenzaA__ACT68166

SEQ ID NO: 169618 - RNA, 1410 nt, Artificial Sequence; identical to SEQ ID NO: 169258
  derived and/or modified sequence opt4 from neuraminidase__InfluenzaA__ACT68167

SEQ ID NO: 169619 - RNA, 1410 nt, Artificial Sequence; identical to SEQ ID NO: 169288
  derived and/or modified sequence opt4 from neuraminidase__InfluenzaA__ACT68168

SEQ ID NO: 169620 - RNA, 1410 nt, Artificial Sequence
  derived and/or modified sequence opt4 from neuraminidase__InfluenzaA__ACT68169
augaaccccaaccagaagaucaucaccaucggcagcgugugcaugaccaucggcauggccaaccugauccugcagaucggcaacaucaucagcaucuggaucagccacagcauccagcugggcgaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacgagaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucagcgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169621 - RNA, 1410 nt, Artificial Sequence; identical to SEQ ID NO: 169248
  derived and/or modified sequence opt4 from neuraminidase__InfluenzaA__ACT68171

SEQ ID NO: 169622 - RNA, 1410 nt, Artificial Sequence; identical to SEQ ID NO: 169248
  derived and/or modified sequence opt4 from neuraminidase__InfluenzaA__ACT68172

SEQ ID NO: 169623 - RNA, 1410 nt, Artificial Sequence; identical to SEQ ID NO: 169258
  derived and/or modified sequence opt4 from neuraminidase__InfluenzaA__ACT68173

SEQ ID NO: 169624 - RNA, 1410 nt, Artificial Sequence; identical to SEQ ID NO: 169258
  derived and/or modified sequence opt4 from neuraminidase__InfluenzaA__ACT68174

SEQ ID NO: 169625 - RNA, 1410 nt, Artificial Sequence
  derived and/or modified sequence opt4 from neuraminidase__InfluenzaA__ACT68175
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcggcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169626 - RNA, 1410 nt, Artificial Sequence; identical to SEQ ID NO: 169258
  derived and/or modified sequence opt4 from neuraminidase__InfluenzaA__ACT68176

SEQ ID NO: 169627 - RNA, 1410 nt, Artificial Sequence; identical to SEQ ID NO: 169258
  derived and/or modified sequence opt4 from neuraminidase__InfluenzaA__ACT68177

SEQ ID NO: 169628 - RNA, 1410 nt, Artificial Sequence; identical to SEQ ID NO: 169258
  derived and/or modified sequence opt4 from neuraminidase__InfluenzaA__ACT68178

SEQ ID NO: 169629 - RNA, 1410 nt, Artificial Sequence; identical to SEQ ID NO: 169625
  derived and/or modified sequence opt4 from neuraminidase__InfluenzaA__ACT68179

SEQ ID NO: 169630 - RNA, 1410 nt, Artificial Sequence; identical to SEQ ID NO: 169258
  derived and/or modified sequence opt4 from neuraminidase__InfluenzaA__ACT68180

SEQ ID NO: 169631 - RNA, 1410 nt, Artificial Sequence; identical to SEQ ID NO: 169288
  derived and/or modified sequence opt4 from neuraminidase__InfluenzaA__ACT79145

SEQ ID NO: 169632 - RNA, 1410 nt, Artificial Sequence
  derived and/or modified sequence opt4 from neuraminidase__InfluenzaA__ACT79155
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugggcggcugggccaucuacagcaaggacaacagcgugagaaucggcagcaagggcgacguguucgugaucagagagcccuucaucagcugcagccugcuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169633 - RNA, 1410 nt, Artificial Sequence; identical to SEQ ID NO: 169248
  derived and/or modified sequence opt4 from neuraminidase__InfluenzaA__ACT79165

SEQ ID NO: 169634 - RNA, 1410 nt, Artificial Sequence; identical to SEQ ID NO: 169248
  derived and/or modified sequence opt4 from neuraminidase__InfluenzaA__ACT79175

SEQ ID NO: 169635 - RNA, 1410 nt, Artificial Sequence; identical to SEQ ID NO: 169258
  derived and/or modified sequence opt4 from neuraminidase__InfluenzaA__ACT79185

SEQ ID NO: 169636 - RNA, 1410 nt, Artificial Sequence; identical to SEQ ID NO: 169258
  derived and/or modified sequence opt4 from neuraminidase__InfluenzaA__ACT79622

SEQ ID NO: 169637 - RNA, 1410 nt, Artificial Sequence; identical to SEQ ID NO: 169625
  derived and/or modified sequence opt4 from neuraminidase__InfluenzaA__ACT79630

SEQ ID NO: 169638 - RNA, 1410 nt, Artificial Sequence; identical to SEQ ID NO: 169258
  derived and/or modified sequence opt4 from neuraminidase__InfluenzaA__ACT83798

SEQ ID NO: 169639 - RNA, 1410 nt, Artificial Sequence; identical to SEQ ID NO: 169258
  derived and/or modified sequence opt4 from neuraminidase__InfluenzaA__ACT83808

SEQ ID NO: 169640 - RNA, 1410 nt, Artificial Sequence; identical to SEQ ID NO: 169258
  derived and/or modified sequence opt4 from neuraminidase__InfluenzaA__ACT83818

SEQ ID NO: 169641 - RNA, 1410 nt, Artificial Sequence; identical to SEQ ID NO: 169258
  derived and/or modified sequence opt4 from neuraminidase__InfluenzaA__ACT83828

SEQ ID NO: 169642 - RNA, 1410 nt, Artificial Sequence; identical to SEQ ID NO: 169258
  derived and/or modified sequence opt4 from neuraminidase__InfluenzaA__ACT83838

SEQ ID NO: 169643 - RNA, 1410 nt, Artificial Sequence; identical to SEQ ID NO: 169248
  derived and/or modified sequence opt4 from neuraminidase__InfluenzaA__ACT83848

SEQ ID NO: 169644 - RNA, 1410 nt, Artificial Sequence; identical to SEQ ID NO: 169248
  derived and/or modified sequence opt4 from neuraminidase__InfluenzaA__ACT83858

SEQ ID NO: 169645 - RNA, 1410 nt, Artificial Sequence; identical to SEQ ID NO: 169258
  derived and/or modified sequence opt4 from neuraminidase__InfluenzaA__ACT83868

SEQ ID NO: 169646 - RNA, 1410 nt, Artificial Sequence; identical to SEQ ID NO: 169258
  derived and/or modified sequence opt4 from neuraminidase__InfluenzaA__ACT83878

SEQ ID NO: 169647 - RNA, 1410 nt, Artificial Sequence; identical to SEQ ID NO: 169258
  derived and/or modified sequence opt4 from neuraminidase__InfluenzaA__ACT86002

SEQ ID NO: 169648 - RNA, 1410 nt, Artificial Sequence; identical to SEQ ID NO: 169258
  derived and/or modified sequence opt4 from neuraminidase__InfluenzaA__ACT86012

SEQ ID NO: 169649 - RNA, 1410 nt, Artificial Sequence; identical to SEQ ID NO: 169258
  derived and/or modified sequence opt4 from neuraminidase__InfluenzaA__ACT86022

SEQ ID NO: 169650 - RNA, 1410 nt, Artificial Sequence; identical to SEQ ID NO: 169248
  derived and/or modified sequence opt4 from neuraminidase__InfluenzaA__ACT86032

SEQ ID NO: 169651 - RNA, 1410 nt, Artificial Sequence; identical to SEQ ID NO: 169258
  derived and/or modified sequence opt4 from neuraminidase__InfluenzaA__ACT86042

SEQ ID NO: 169652 - RNA, 1410 nt, Artificial Sequence; identical to SEQ ID NO: 169258
  derived and/or modified sequence opt4 from neuraminidase__InfluenzaA__ACT86052

SEQ ID NO: 169653 - RNA, 1410 nt, Artificial Sequence; identical to SEQ ID NO: 169258
  derived and/or modified sequence opt4 from neuraminidase__InfluenzaA__ACT86062

SEQ ID NO: 169654 - RNA, 1410 nt, Artificial Sequence; identical to SEQ ID NO: 169258
  derived and/or modified sequence opt4 from neuraminidase__InfluenzaA__ACT86072

SEQ ID NO: 169655 - RNA, 1410 nt, Artificial Sequence; identical to SEQ ID NO: 169258
  derived and/or modified sequence opt4 from neuraminidase__InfluenzaA__ACT86082

SEQ ID NO: 169656 - RNA, 1410 nt, Artificial Sequence; identical to SEQ ID NO: 169258
  derived and/or modified sequence opt4 from neuraminidase__InfluenzaA__ACT86092

SEQ ID NO: 169657 - RNA, 1410 nt, Artificial Sequence; identical to SEQ ID NO: 169258
  derived and/or modified sequence opt4 from neuraminidase__InfluenzaA__ACT86102

SEQ ID NO: 169658 - RNA, 1410 nt, Artificial Sequence; identical to SEQ ID NO: 169258
  derived and/or modified sequence opt4 from neuraminidase__InfluenzaA__ACT86112

SEQ ID NO: 169659 - RNA, 1410 nt, Artificial Sequence; identical to SEQ ID NO: 169258
  derived and/or modified sequence opt4 from neuraminidase__InfluenzaA__ACT86122

SEQ ID NO: 169660 - RNA, 1410 nt, Artificial Sequence; identical to SEQ ID NO: 169258
  derived and/or modified sequence opt4 from neuraminidase__InfluenzaA__ACT86132

SEQ ID NO: 169661 - RNA, 1410 nt, Artificial Sequence; identical to SEQ ID NO: 169258
  derived and/or modified sequence opt4 from neuraminidase__InfluenzaA__ACT86142

SEQ ID NO: 169662 - RNA, 1410 nt, Artificial Sequence; identical to SEQ ID NO: 169248
  derived and/or modified sequence opt4 from neuraminidase__InfluenzaA__ACT97323

SEQ ID NO: 169663 - RNA, 1410 nt, Artificial Sequence; identical to SEQ ID NO: 169258
  derived and/or modified sequence opt4 from neuraminidase__InfluenzaA__ACU00934

SEQ ID NO: 169664 - RNA, 1410 nt, Artificial Sequence; identical to SEQ ID NO: 169258
  derived and/or modified sequence opt4 from neuraminidase__InfluenzaA__ACU00944

SEQ ID NO: 169665 - RNA, 1410 nt, Artificial Sequence; identical to SEQ ID NO: 169612
  derived and/or modified sequence opt4 from neuraminidase__InfluenzaA__ACU00954

SEQ ID NO: 169666 - RNA, 1410 nt, Artificial Sequence
  derived and/or modified sequence opt4 from neuraminidase__InfluenzaA__ACU12497
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcccugcgagcccaccaucaucgagagaaacaucaccgagaucguguaccugaccaacaccaccaucgagagagagaucugccccaagcugguggaguacagaaacuggagcaagccccagugcagagugaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucgugagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaccaacagacaggugaucguggacagaggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 169667 - RNA, 1413 nt, Artificial Sequence; identical to SEQ ID NO: 169152
  derived and/or modified sequence opt4 from neuraminidase__InfluenzaA__ACU12508

SEQ ID NO: 169668 - RNA, 1410 nt, Artificial Sequence
  derived and/or modified sequence opt4 from neuraminidase__InfluenzaA__ACU12519
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacgagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 169669 - RNA, 1410 nt, Artificial Sequence
  derived and/or modified sequence opt4 from neuraminidase__InfluenzaA__ACU12530
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcaacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169670 - RNA, 1410 nt, Artificial Sequence
  derived and/or modified sequence opt4 from neuraminidase__InfluenzaA__ACU12541
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaaguggcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169671 - RNA, 1410 nt, Artificial Sequence
  derived and/or modified sequence opt4 from neuraminidase__InfluenzaA__ACU12552
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcggcuacgugugcagcggccuggugggcgacacccccagaaagaacgacagcagcagcagcagccacugcagcgaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169672 - RNA, 1413 nt, Artificial Sequence
  derived and/or modified sequence opt4 from neuraminidase__InfluenzaA__ACU12574
augaaccccaaccagaagaucaucaccaucggcagcaucagcaucgccaucggcaucaucaaccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169673 - RNA, 1413 nt, Artificial Sequence; identical to SEQ ID NO: 169152
  derived and/or modified sequence opt4 from neuraminidase__InfluenzaA__ACU12585

SEQ ID NO: 169674 - RNA, 1413 nt, Artificial Sequence
  derived and/or modified sequence opt4 from neuraminidase__InfluenzaA__ACU12596
augaaccccaaccagaagaucaucaccaucggcagcaucagcaucgccaucggcaucaucagccugaugcugcagaucggcagcaucaucagcaucugggccagccacagcaucagaaccggcagccagaacaacaccggcaucugcaaccagagaaucaucaccuacgagaacagcaccugggugaaccacaccuacgugaacaucaacaacaccaacgugguggccggcgaggacaagaagagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169675 - RNA, 1410 nt, Artificial Sequence; identical to SEQ ID NO: 169258
  derived and/or modified sequence opt4 from neuraminidase__InfluenzaA__ACU13077

SEQ ID NO: 169676 - RNA, 1410 nt, Artificial Sequence; identical to SEQ ID NO: 169258
  derived and/or modified sequence opt4 from neuraminidase__InfluenzaA__ACU13078

SEQ ID NO: 169677 - RNA, 1410 nt, Artificial Sequence; identical to SEQ ID NO: 169258
  derived and/or modified sequence opt4 from neuraminidase__InfluenzaA__ACU13079

SEQ ID NO: 169678 - RNA, 1410 nt, Artificial Sequence; identical to SEQ ID NO: 169258
  derived and/or modified sequence opt4 from neuraminidase__InfluenzaA__ACU13080

SEQ ID NO: 169679 - RNA, 1410 nt, Artificial Sequence; identical to SEQ ID NO: 169248
  derived and/or modified sequence opt4 from neuraminidase__InfluenzaA__ACU13081

SEQ ID NO: 169680 - RNA, 1410 nt, Artificial Sequence; identical to SEQ ID NO: 169258
  derived and/or modified sequence opt4 from neuraminidase__InfluenzaA__ACU13082

SEQ ID NO: 169681 - RNA, 1410 nt, Artificial Sequence; identical to SEQ ID NO: 169258
  derived and/or modified sequence opt4 from neuraminidase__InfluenzaA__ACU13083

SEQ ID NO: 169682 - RNA, 1410 nt, Artificial Sequence
  derived and/or modified sequence opt4 from neuraminidase__InfluenzaA__ACU13084
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcaugaagcuggccggcaacagcagccugugccccgugggcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169683 - RNA, 1410 nt, Artificial Sequence; identical to SEQ ID NO: 169258
  derived and/or modified sequence opt4 from neuraminidase__InfluenzaA__ACU16799

SEQ ID NO: 169684 - RNA, 1410 nt, Artificial Sequence; identical to SEQ ID NO: 169258
  derived and/or modified sequence opt4 from neuraminidase__InfluenzaA__ACU16861

SEQ ID NO: 169685 - RNA, 1410 nt, Artificial Sequence; identical to SEQ ID NO: 169258
  derived and/or modified sequence opt4 from neuraminidase__InfluenzaA__ACU16934

SEQ ID NO: 169686 - RNA, 1410 nt, Artificial Sequence; identical to SEQ ID NO: 169258
  derived and/or modified sequence opt4 from neuraminidase__InfluenzaA__ACU16997

SEQ ID NO: 169687 - RNA, 1410 nt, Artificial Sequence; identical to SEQ ID NO: 169258
  derived and/or modified sequence opt4 from neuraminidase__InfluenzaA__ACU17130

SEQ ID NO: 169688 - RNA, 1410 nt, Artificial Sequence; identical to SEQ ID NO: 169258
  derived and/or modified sequence opt4 from neuraminidase__InfluenzaA__ACU17191

SEQ ID NO: 169689 - RNA, 1410 nt, Artificial Sequence
  derived and/or modified sequence opt4 from neuraminidase__InfluenzaA__ACU17262
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169690 - RNA, 1410 nt, Artificial Sequence; identical to SEQ ID NO: 169258
  derived and/or modified sequence opt4 from neuraminidase__InfluenzaA__ACU17325

SEQ ID NO: 169691 - RNA, 1410 nt, Artificial Sequence; identical to SEQ ID NO: 169258
  derived and/or modified sequence opt4 from neuraminidase__InfluenzaA__ACU17393

SEQ ID NO: 169692 - RNA, 1410 nt, Artificial Sequence; identical to SEQ ID NO: 169258
  derived and/or modified sequence opt4 from neuraminidase__InfluenzaA__ACU17454

SEQ ID NO: 169693 - RNA, 1410 nt, Artificial Sequence; identical to SEQ ID NO: 169258
  derived and/or modified sequence opt4 from neuraminidase__InfluenzaA__ACU17524

SEQ ID NO: 169694 - RNA, 1410 nt, Artificial Sequence; identical to SEQ ID NO: 169612
  derived and/or modified sequence opt4 from neuraminidase__InfluenzaA__ACU27043

SEQ ID NO: 169695 - RNA, 1413 nt, Artificial Sequence
  derived and/or modified sequence opt4 from neuraminidase__InfluenzaA__ACU27415
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugaccuucgccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169696 - RNA, 1413 nt, Artificial Sequence; identical to SEQ ID NO: 169695
  derived and/or modified sequence opt4 from neuraminidase__InfluenzaA__ACU27416

SEQ ID NO: 169697 - RNA, 1410 nt, Artificial Sequence; identical to SEQ ID NO: 169248
  derived and/or modified sequence opt4 from neuraminidase__InfluenzaA__ACU29961

SEQ ID NO: 169698 - RNA, 1410 nt, Artificial Sequence
  derived and/or modified sequence opt4 from neuraminidase__InfluenzaA__ACU29971
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggagcgacggcgccgagcugcccuucaccaucgacaaguga

SEQ ID NO: 169699 - RNA, 1410 nt, Artificial Sequence; identical to SEQ ID NO: 169258
  derived and/or modified sequence opt4 from neuraminidase__InfluenzaA__ACU29981

SEQ ID NO: 169700 - RNA, 1410 nt, Artificial Sequence; identical to SEQ ID NO: 169258
  derived and/or modified sequence opt4 from neuraminidase__InfluenzaA__ACU29991

SEQ ID NO: 169701 - RNA, 1410 nt, Artificial Sequence; identical to SEQ ID NO: 169258
  derived and/or modified sequence opt4 from neuraminidase__InfluenzaA__ACU30001

SEQ ID NO: 169702 - RNA, 1410 nt, Artificial Sequence; identical to SEQ ID NO: 169258
  derived and/or modified sequence opt4 from neuraminidase__InfluenzaA__ACU30021

SEQ ID NO: 169703 - RNA, 1410 nt, Artificial Sequence
  derived and/or modified sequence opt4 from neuraminidase__InfluenzaA__ACU30085
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcugaugggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169704 - RNA, 1410 nt, Artificial Sequence; identical to SEQ ID NO: 169682
  derived and/or modified sequence opt4 from neuraminidase__InfluenzaA__ACU30095

SEQ ID NO: 169705 - RNA, 1410 nt, Artificial Sequence; identical to SEQ ID NO: 169258
  derived and/or modified sequence opt4 from neuraminidase__InfluenzaA__ACU30105

SEQ ID NO: 169706 - RNA, 1410 nt, Artificial Sequence; identical to SEQ ID NO: 169258
  derived and/or modified sequence opt4 from neuraminidase__InfluenzaA__ACU30114

SEQ ID NO: 169707 - RNA, 1410 nt, Artificial Sequence; identical to SEQ ID NO: 169258
  derived and/or modified sequence opt4 from neuraminidase__InfluenzaA__ACU30123

SEQ ID NO: 169708 - RNA, 1410 nt, Artificial Sequence
  derived and/or modified sequence opt4 from neuraminidase__InfluenzaA__ACU31177
augaaccccaaccagaagaucaucaccaucggcagcgugugcaugaccaucggcauggccaaccugauccugcagaucggcaacaucaucagcaucuggaucagccaccugauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169709 - RNA, 1410 nt, Artificial Sequence; identical to SEQ ID NO: 169258
  derived and/or modified sequence opt4 from neuraminidase__InfluenzaA__ACU31178

SEQ ID NO: 169710 - RNA, 1410 nt, Artificial Sequence; identical to SEQ ID NO: 169248
  derived and/or modified sequence opt4 from neuraminidase__InfluenzaA__ACU31179

SEQ ID NO: 169711 - RNA, 1410 nt, Artificial Sequence; identical to SEQ ID NO: 169248
  derived and/or modified sequence opt4 from neuraminidase__InfluenzaA__ACU31180

SEQ ID NO: 169712 - RNA, 1410 nt, Artificial Sequence; identical to SEQ ID NO: 169248
  derived and/or modified sequence opt4 from neuraminidase__InfluenzaA__ACU31181

SEQ ID NO: 169713 - RNA, 1410 nt, Artificial Sequence; identical to SEQ ID NO: 169258
  derived and/or modified sequence opt4 from neuraminidase__InfluenzaA__ACU31182

SEQ ID NO: 169714 - RNA, 1410 nt, Artificial Sequence; identical to SEQ ID NO: 169288
  derived and/or modified sequence opt4 from neuraminidase__InfluenzaA__ACU31183

SEQ ID NO: 169715 - RNA, 1410 nt, Artificial Sequence; identical to SEQ ID NO: 169258
  derived and/or modified sequence opt4 from neuraminidase__InfluenzaA__ACU31184

SEQ ID NO: 169716 - RNA, 1410 nt, Artificial Sequence; identical to SEQ ID NO: 169248
  derived and/or modified sequence opt4 from neuraminidase__InfluenzaA__ACU31185

SEQ ID NO: 169717 - RNA, 1410 nt, Artificial Sequence; identical to SEQ ID NO: 169248
  derived and/or modified sequence opt4 from neuraminidase__InfluenzaA__ACU31186

SEQ ID NO: 169718 - RNA, 1410 nt, Artificial Sequence; identical to SEQ ID NO: 169248
  derived and/or modified sequence opt4 from neuraminidase__InfluenzaA__ACU31187

SEQ ID NO: 169719 - RNA, 1410 nt, Artificial Sequence; identical to SEQ ID NO: 169248
  derived and/or modified sequence opt4 from neuraminidase__InfluenzaA__ACU31188

SEQ ID NO: 169720 - RNA, 1350 nt, Artificial Sequence
  derived and/or modified sequence opt4 from neuraminidase__InfluenzaA__ACU46645
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaaccugcugaccgagaagaccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcggccccgugggcgaggcccccagccccuacaacagcagauucgaguacguggccuggagcgccagcgccugccacgacagaaccagcagacugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcgccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 169721 - RNA, 1410 nt, Artificial Sequence
  derived and/or modified sequence opt4 from neuraminidase__InfluenzaA__ACU56927
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgacaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169722 - RNA, 1410 nt, Artificial Sequence; identical to SEQ ID NO: 169413
  derived and/or modified sequence opt4 from neuraminidase__InfluenzaA__ACU56934

SEQ ID NO: 169723 - RNA, 1410 nt, Artificial Sequence; identical to SEQ ID NO: 169258
  derived and/or modified sequence opt4 from neuraminidase__InfluenzaA__ACU64791

SEQ ID NO: 169724 - RNA, 1410 nt, Artificial Sequence
  derived and/or modified sequence opt4 from neuraminidase__InfluenzaA__ACU64811
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcauggugagcgugaagcuggccggcaacagcagccugugccccgugagcggcugggccaucuacagcaaggacaacagcgugagaaucggcagcaagggcgacguguucaucaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169725 - RNA, 1410 nt, Artificial Sequence; identical to SEQ ID NO: 169023
  derived and/or modified sequence opt4 from neuraminidase__InfluenzaA__ACU79885

SEQ ID NO: 169726 - RNA, 1410 nt, Artificial Sequence; identical to SEQ ID NO: 166615
  derived and/or modified sequence opt4 from neuraminidase__InfluenzaA__ACU79896

SEQ ID NO: 169727 - RNA, 1410 nt, Artificial Sequence; identical to SEQ ID NO: 166615
  derived and/or modified sequence opt4 from neuraminidase__InfluenzaA__ACU79918

SEQ ID NO: 169728 - RNA, 1410 nt, Artificial Sequence; identical to SEQ ID NO: 166615
  derived and/or modified sequence opt4 from neuraminidase__InfluenzaA__ACU79929

SEQ ID NO: 169729 - RNA, 1413 nt, Artificial Sequence
  derived and/or modified sequence opt4 from neuraminidase__InfluenzaA__ACU79940
augaaccccaaccagaagaucaucaccaucggcagcaucagcaucgugaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcgugaagcaggacgugguggccaugaccgacuggagcggcuacagcggcagcuucgugcagcaccccgagcugaccggccuggacugcaucagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169730 - RNA, 1410 nt, Artificial Sequence
  derived and/or modified sequence opt4 from neuraminidase__InfluenzaA__ACU79951
augaaccccaaccagaagaucaucaccaucggcagcgugagccugaccaucgagaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggacagcagaagcggcuacgagaccuucaaggugaucggcggcuggagcacccccaacagcaagagccaggugaacagacaggugaucgugggcaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 169731 - RNA, 1410 nt, Artificial Sequence; identical to SEQ ID NO: 169123
  derived and/or modified sequence opt4 from neuraminidase__InfluenzaA__ACU79973

SEQ ID NO: 169732 - RNA, 1413 nt, Artificial Sequence; identical to SEQ ID NO: 169152
  derived and/or modified sequence opt4 from neuraminidase__InfluenzaA__ACU79984

SEQ ID NO: 169733 - RNA, 1410 nt, Artificial Sequence; identical to SEQ ID NO: 169119
  derived and/or modified sequence opt4 from neuraminidase__InfluenzaA__ACU80006

SEQ ID NO: 169734 - RNA, 1410 nt, Artificial Sequence
  derived and/or modified sequence opt4 from neuraminidase__InfluenzaA__ACU80017
augaacaccaaccagagaaucaucaccaucggcaccaucugccugaucgugggcaucaucagccugcugcugcagaucggcaacaucauccugcuguggaugagccacagcauccagaccggcgagaagagccaccccaaggugugcaaccagagcgugaucaccuacgagaacaacaccugggugaaccagaccuacgugaacaucagcaacaccaacaucgccgccggccagggcgugacccccaucauccuggccggcaacagcagccugugccccaucagcggcugggccaucuacagcaaggacaacagcaucagaaucggcagcaagggcgacaucuucgugaugagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagcuguucaagauggagaagggcaagaucaucagaagcaucgagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcgugaacagcggcaccgccagcuggagcuggcccgacggcgccgaccugcccuucaccaucgacaaguga

SEQ ID NO: 169735 - RNA, 1413 nt, Artificial Sequence; identical to SEQ ID NO: 169152
  derived and/or modified sequence opt4 from neuraminidase__InfluenzaA__ACU80028

SEQ ID NO: 169736 - RNA, 1410 nt, Artificial Sequence; identical to SEQ ID NO: 169119
  derived and/or modified sequence opt4 from neuraminidase__InfluenzaA__ACU80039

SEQ ID NO: 169737 - RNA, 1413 nt, Artificial Sequence; identical to SEQ ID NO: 169236
  derived and/or modified sequence opt4 from neuraminidase__InfluenzaA__ACU80050

SEQ ID NO: 169738 - RNA, 1410 nt, Artificial Sequence; identical to SEQ ID NO: 169669
  derived and/or modified sequence opt4 from neuraminidase__InfluenzaA__ACU80061

SEQ ID NO: 169739 - RNA, 1413 nt, Artificial Sequence; identical to SEQ ID NO: 169152
  derived and/or modified sequence opt4 from neuraminidase__InfluenzaA__ACU80072

SEQ ID NO: 169740 - RNA, 1413 nt, Artificial Sequence; identical to SEQ ID NO: 169152
  derived and/or modified sequence opt4 from neuraminidase__InfluenzaA__ACU80094

SEQ ID NO: 169741 - RNA, 1410 nt, Artificial Sequence; identical to SEQ ID NO: 169123
  derived and/or modified sequence opt4 from neuraminidase__InfluenzaA__ACU80105

SEQ ID NO: 169742 - RNA, 1410 nt, Artificial Sequence; identical to SEQ ID NO: 169123
  derived and/or modified sequence opt4 from neuraminidase__InfluenzaA__ACU80127

SEQ ID NO: 169743 - RNA, 1410 nt, Artificial Sequence; identical to SEQ ID NO: 169123
  derived and/or modified sequence opt4 from neuraminidase__InfluenzaA__ACU80138

SEQ ID NO: 169744 - RNA, 1410 nt, Artificial Sequence; identical to SEQ ID NO: 169119
  derived and/or modified sequence opt4 from neuraminidase__InfluenzaA__ACU80160

SEQ ID NO: 169745 - RNA, 1413 nt, Artificial Sequence; identical to SEQ ID NO: 169152
  derived and/or modified sequence opt4 from neuraminidase__InfluenzaA__ACU80171

SEQ ID NO: 169746 - RNA, 1410 nt, Artificial Sequence; identical to SEQ ID NO: 169032
  derived and/or modified sequence opt4 from neuraminidase__InfluenzaA__ACU80182

SEQ ID NO: 169747 - RNA, 1410 nt, Artificial Sequence
  derived and/or modified sequence opt4 from neuraminidase__InfluenzaA__ACU80193
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169748 - RNA, 1410 nt, Artificial Sequence; identical to SEQ ID NO: 169032
  derived and/or modified sequence opt4 from neuraminidase__InfluenzaA__ACU80204

SEQ ID NO: 169749 - RNA, 1413 nt, Artificial Sequence
  derived and/or modified sequence opt4 from neuraminidase__InfluenzaA__ACU80237
augaaccccaaccagaagaucaucaccaucggcagcaucagcaucgccaucggcaucaucagccugaugcugcagaucggcaacaucaucagcaucugggccagccacagcauccagaccggcaaccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169750 - RNA, 1410 nt, Artificial Sequence; identical to SEQ ID NO: 169123
  derived and/or modified sequence opt4 from neuraminidase__InfluenzaA__ACU80248

SEQ ID NO: 169751 - RNA, 1410 nt, Artificial Sequence; identical to SEQ ID NO: 169123
  derived and/or modified sequence opt4 from neuraminidase__InfluenzaA__ACU80259

SEQ ID NO: 169752 - RNA, 1413 nt, Artificial Sequence
  derived and/or modified sequence opt4 from neuraminidase__InfluenzaA__ACU80270
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccagcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169753 - RNA, 1413 nt, Artificial Sequence
  derived and/or modified sequence opt4 from neuraminidase__InfluenzaA__ACU80281
augaaccagaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169754 - RNA, 1410 nt, Artificial Sequence
  derived and/or modified sequence opt4 from neuraminidase__InfluenzaA__ACU80303
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggcaacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169755 - RNA, 1410 nt, Artificial Sequence; identical to SEQ ID NO: 169123
  derived and/or modified sequence opt4 from neuraminidase__InfluenzaA__ACU80314

SEQ ID NO: 169756 - RNA, 1410 nt, Artificial Sequence; identical to SEQ ID NO: 169123
  derived and/or modified sequence opt4 from neuraminidase__InfluenzaA__ACU80325

SEQ ID NO: 169757 - RNA, 1410 nt, Artificial Sequence; identical to SEQ ID NO: 169119
  derived and/or modified sequence opt4 from neuraminidase__InfluenzaA__ACU80336

SEQ ID NO: 169758 - RNA, 1410 nt, Artificial Sequence; identical to SEQ ID NO: 169123
  derived and/or modified sequence opt4 from neuraminidase__InfluenzaA__ACU80347

SEQ ID NO: 169759 - RNA, 1410 nt, Artificial Sequence; identical to SEQ ID NO: 169123
  derived and/or modified sequence opt4 from neuraminidase__InfluenzaA__ACU80358

SEQ ID NO: 169760 - RNA, 1410 nt, Artificial Sequence; identical to SEQ ID NO: 169123
  derived and/or modified sequence opt4 from neuraminidase__InfluenzaA__ACU80369

SEQ ID NO: 169761 - RNA, 1410 nt, Artificial Sequence; identical to SEQ ID NO: 169123
  derived and/or modified sequence opt4 from neuraminidase__InfluenzaA__ACU80380

SEQ ID NO: 169762 - RNA, 1410 nt, Artificial Sequence
  derived and/or modified sequence opt4 from neuraminidase__InfluenzaA__ACU80391
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaucaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169763 - RNA, 1410 nt, Artificial Sequence; identical to SEQ ID NO: 169119
  derived and/or modified sequence opt4 from neuraminidase__InfluenzaA__ACU80402

SEQ ID NO: 169764 - RNA, 1413 nt, Artificial Sequence; identical to SEQ ID NO: 169152
  derived and/or modified sequence opt4 from neuraminidase__InfluenzaA__ACU80413

SEQ ID NO: 169765 - RNA, 1410 nt, Artificial Sequence; identical to SEQ ID NO: 169123
  derived and/or modified sequence opt4 from neuraminidase__InfluenzaA__ACU80427

SEQ ID NO: 169766 - RNA, 1410 nt, Artificial Sequence; identical to SEQ ID NO: 169123
  derived and/or modified sequence opt4 from neuraminidase__InfluenzaA__ACU80438

SEQ ID NO: 169767 - RNA, 1410 nt, Artificial Sequence; identical to SEQ ID NO: 169119
  derived and/or modified sequence opt4 from neuraminidase__InfluenzaA__ACU80461

SEQ ID NO: 169768 - RNA, 1410 nt, Artificial Sequence; identical to SEQ ID NO: 169123
  derived and/or modified sequence opt4 from neuraminidase__InfluenzaA__ACU80603

SEQ ID NO: 169769 - RNA, 1410 nt, Artificial Sequence; identical to SEQ ID NO: 169123
  derived and/or modified sequence opt4 from neuraminidase__InfluenzaA__ACU80614

SEQ ID NO: 169770 - RNA, 1410 nt, Artificial Sequence; identical to SEQ ID NO: 169123
  derived and/or modified sequence opt4 from neuraminidase__InfluenzaA__ACU80625

SEQ ID NO: 169771 - RNA, 1410 nt, Artificial Sequence; identical to SEQ ID NO: 169119
  derived and/or modified sequence opt4 from neuraminidase__InfluenzaA__ACU80636

SEQ ID NO: 169772 - RNA, 1410 nt, Artificial Sequence
  derived and/or modified sequence opt4 from neuraminidase__InfluenzaA__ACU80647
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169773 - RNA, 1410 nt, Artificial Sequence
  derived and/or modified sequence opt4 from neuraminidase__InfluenzaA__ACU80658
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaagaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169774 - RNA, 1410 nt, Artificial Sequence; identical to SEQ ID NO: 169032
  derived and/or modified sequence opt4 from neuraminidase__InfluenzaA__ACU80669

SEQ ID NO: 169775 - RNA, 1410 nt, Artificial Sequence; identical to SEQ ID NO: 169119
  derived and/or modified sequence opt4 from neuraminidase__InfluenzaA__ACU80691

SEQ ID NO: 169776 - RNA, 1410 nt, Artificial Sequence; identical to SEQ ID NO: 169123
  derived and/or modified sequence opt4 from neuraminidase__InfluenzaA__ACU80702

SEQ ID NO: 169777 - RNA, 1410 nt, Artificial Sequence; identical to SEQ ID NO: 169123
  derived and/or modified sequence opt4 from neuraminidase__InfluenzaA__ACU80713

SEQ ID NO: 169778 - RNA, 1410 nt, Artificial Sequence; identical to SEQ ID NO: 169119
  derived and/or modified sequence opt4 from neuraminidase__InfluenzaA__ACU80724

SEQ ID NO: 169779 - RNA, 1410 nt, Artificial Sequence; identical to SEQ ID NO: 169032
  derived and/or modified sequence opt4 from neuraminidase__InfluenzaA__ACU80735

SEQ ID NO: 169780 - RNA, 1410 nt, Artificial Sequence; identical to SEQ ID NO: 169119
  derived and/or modified sequence opt4 from neuraminidase__InfluenzaA__ACU80746

SEQ ID NO: 169781 - RNA, 1410 nt, Artificial Sequence
  derived and/or modified sequence opt4 from neuraminidase__InfluenzaA__ACU80757
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgaggugguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169782 - RNA, 1410 nt, Artificial Sequence; identical to SEQ ID NO: 169747
  derived and/or modified sequence opt4 from neuraminidase__InfluenzaA__ACU80768

SEQ ID NO: 169783 - RNA, 1410 nt, Artificial Sequence; identical to SEQ ID NO: 169119
  derived and/or modified sequence opt4 from neuraminidase__InfluenzaA__ACU80779

SEQ ID NO: 169784 - RNA, 1410 nt, Artificial Sequence; identical to SEQ ID NO: 169032
  derived and/or modified sequence opt4 from neuraminidase__InfluenzaA__ACU80790

SEQ ID NO: 169785 - RNA, 1410 nt, Artificial Sequence; identical to SEQ ID NO: 169119
  derived and/or modified sequence opt4 from neuraminidase__InfluenzaA__ACU80801

SEQ ID NO: 169786 - RNA, 1410 nt, Artificial Sequence
  derived and/or modified sequence opt4 from neuraminidase__InfluenzaA__ACU81106
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagcagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169787 - RNA, 1410 nt, Artificial Sequence; identical to SEQ ID NO: 169413
  derived and/or modified sequence opt4 from neuraminidase__InfluenzaA__ACU87265

SEQ ID NO: 169788 - RNA, 1410 nt, Artificial Sequence; identical to SEQ ID NO: 169258
  derived and/or modified sequence opt4 from neuraminidase__InfluenzaA__ACU87273

SEQ ID NO: 169789 - RNA, 1410 nt, Artificial Sequence; identical to SEQ ID NO: 169258
  derived and/or modified sequence opt4 from neuraminidase__InfluenzaA__ACV04231

SEQ ID NO: 169790 - RNA, 1410 nt, Artificial Sequence; identical to SEQ ID NO: 169258
  derived and/or modified sequence opt4 from neuraminidase__InfluenzaA__ACV04241

SEQ ID NO: 169791 - RNA, 1410 nt, Artificial Sequence; identical to SEQ ID NO: 169258
  derived and/or modified sequence opt4 from neuraminidase__InfluenzaA__ACV04251

SEQ ID NO: 169792 - RNA, 1410 nt, Artificial Sequence; identical to SEQ ID NO: 169258
  derived and/or modified sequence opt4 from neuraminidase__InfluenzaA__ACV04261

SEQ ID NO: 169793 - RNA, 1410 nt, Artificial Sequence; identical to SEQ ID NO: 169258
  derived and/or modified sequence opt4 from neuraminidase__InfluenzaA__ACV04271

SEQ ID NO: 169794 - RNA, 1410 nt, Artificial Sequence
  derived and/or modified sequence opt4 from neuraminidase__InfluenzaA__ACV04281
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucggcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169795 - RNA, 1410 nt, Artificial Sequence; identical to SEQ ID NO: 169258
  derived and/or modified sequence opt4 from neuraminidase__InfluenzaA__ACV04291

SEQ ID NO: 169796 - RNA, 1410 nt, Artificial Sequence; identical to SEQ ID NO: 169258
  derived and/or modified sequence opt4 from neuraminidase__InfluenzaA__ACV04301

SEQ ID NO: 169797 - RNA, 1410 nt, Artificial Sequence; identical to SEQ ID NO: 169258
  derived and/or modified sequence opt4 from neuraminidase__InfluenzaA__ACV04321

SEQ ID NO: 169798 - RNA, 1410 nt, Artificial Sequence; identical to SEQ ID NO: 169258
  derived and/or modified sequence opt4 from neuraminidase__InfluenzaA__ACV04331

SEQ ID NO: 169799 - RNA, 1410 nt, Artificial Sequence; identical to SEQ ID NO: 169258
  derived and/or modified sequence opt4 from neuraminidase__InfluenzaA__ACV04341

SEQ ID NO: 169800 - RNA, 1410 nt, Artificial Sequence; identical to SEQ ID NO: 169258
  derived and/or modified sequence opt4 from neuraminidase__InfluenzaA__ACV04351

SEQ ID NO: 169801 - RNA, 1410 nt, Artificial Sequence; identical to SEQ ID NO: 169258
  derived and/or modified sequence opt4 from neuraminidase__InfluenzaA__ACV04361

SEQ ID NO: 169802 - RNA, 1410 nt, Artificial Sequence; identical to SEQ ID NO: 169258
  derived and/or modified sequence opt4 from neuraminidase__InfluenzaA__ACV04371

SEQ ID NO: 169803 - RNA, 1410 nt, Artificial Sequence; identical to SEQ ID NO: 169258
  derived and/or modified sequence opt4 from neuraminidase__InfluenzaA__ACV04381

SEQ ID NO: 169804 - RNA, 1410 nt, Artificial Sequence; identical to SEQ ID NO: 169258
  derived and/or modified sequence opt4 from neuraminidase__InfluenzaA__ACV04391

SEQ ID NO: 169805 - RNA, 1410 nt, Artificial Sequence; identical to SEQ ID NO: 169258
  derived and/or modified sequence opt4 from neuraminidase__InfluenzaA__ACV04401

SEQ ID NO: 169806 - RNA, 1410 nt, Artificial Sequence; identical to SEQ ID NO: 169248
  derived and/or modified sequence opt4 from neuraminidase__InfluenzaA__ACV04411

SEQ ID NO: 169807 - RNA, 1410 nt, Artificial Sequence; identical to SEQ ID NO: 169258
  derived and/or modified sequence opt4 from neuraminidase__InfluenzaA__ACV04492

SEQ ID NO: 169808 - RNA, 1410 nt, Artificial Sequence; identical to SEQ ID NO: 169258
  derived and/or modified sequence opt4 from neuraminidase__InfluenzaA__ACV04502

SEQ ID NO: 169809 - RNA, 1410 nt, Artificial Sequence; identical to SEQ ID NO: 169248
  derived and/or modified sequence opt4 from neuraminidase__InfluenzaA__ACV04512

SEQ ID NO: 169810 - RNA, 1410 nt, Artificial Sequence
  derived and/or modified sequence opt4 from neuraminidase__InfluenzaA__ACV04522
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggcaagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169811 - RNA, 1410 nt, Artificial Sequence; identical to SEQ ID NO: 169258
  derived and/or modified sequence opt4 from neuraminidase__InfluenzaA__ACV04532

SEQ ID NO: 169812 - RNA, 1410 nt, Artificial Sequence; identical to SEQ ID NO: 169258
  derived and/or modified sequence opt4 from neuraminidase__InfluenzaA__ACV04542

SEQ ID NO: 169813 - RNA, 1410 nt, Artificial Sequence; identical to SEQ ID NO: 169258
  derived and/or modified sequence opt4 from neuraminidase__InfluenzaA__ACV04552

SEQ ID NO: 169814 - RNA, 1410 nt, Artificial Sequence; identical to SEQ ID NO: 169258
  derived and/or modified sequence opt4 from neuraminidase__InfluenzaA__ACV04562

SEQ ID NO: 169815 - RNA, 1410 nt, Artificial Sequence; identical to SEQ ID NO: 169248
  derived and/or modified sequence opt4 from neuraminidase__InfluenzaA__ACV04572

SEQ ID NO: 169816 - RNA, 1410 nt, Artificial Sequence; identical to SEQ ID NO: 169258
  derived and/or modified sequence opt4 from neuraminidase__InfluenzaA__ACV04582

SEQ ID NO: 169817 - RNA, 1410 nt, Artificial Sequence
  derived and/or modified sequence opt4 from neuraminidase__InfluenzaA__ACV04758
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccccagcgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169818 - RNA, 1410 nt, Artificial Sequence; identical to SEQ ID NO: 169248
  derived and/or modified sequence opt4 from neuraminidase__InfluenzaA__ACV33087

SEQ ID NO: 169819 - RNA, 1410 nt, Artificial Sequence; identical to SEQ ID NO: 169258
  derived and/or modified sequence opt4 from neuraminidase__InfluenzaA__ACV33107

SEQ ID NO: 169820 - RNA, 1410 nt, Artificial Sequence; identical to SEQ ID NO: 169258
  derived and/or modified sequence opt4 from neuraminidase__InfluenzaA__ACV33117

SEQ ID NO: 169821 - RNA, 1410 nt, Artificial Sequence; identical to SEQ ID NO: 169258
  derived and/or modified sequence opt4 from neuraminidase__InfluenzaA__ACV33127

SEQ ID NO: 169822 - RNA, 1410 nt, Artificial Sequence; identical to SEQ ID NO: 169258
  derived and/or modified sequence opt4 from neuraminidase__InfluenzaA__ACV33137

SEQ ID NO: 169823 - RNA, 1410 nt, Artificial Sequence; identical to SEQ ID NO: 169258
  derived and/or modified sequence opt4 from neuraminidase__InfluenzaA__ACV33147

SEQ ID NO: 169824 - RNA, 1410 nt, Artificial Sequence
  derived and/or modified sequence opt4 from neuraminidase__InfluenzaA__ACV33157
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccgugggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169825 - RNA, 1410 nt, Artificial Sequence
  derived and/or modified sequence opt4 from neuraminidase__InfluenzaA__ACV33167
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 169826 - RNA, 1410 nt, Artificial Sequence; identical to SEQ ID NO: 169258
  derived and/or modified sequence opt4 from neuraminidase__InfluenzaA__ACV33177

SEQ ID NO: 169827 - RNA, 1410 nt, Artificial Sequence
  derived and/or modified sequence opt4 from neuraminidase__InfluenzaA__ACV41993
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaucugcaaccagagcgugaucaccuacgagaacaacaccugggugaaccagaccuacgugaacaucagcaacaccaacuucgccgccggccagagcguggugagcgugaagcuggccggcaacagcagccugugccccgugggcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169828 - RNA, 1410 nt, Artificial Sequence; identical to SEQ ID NO: 169258
  derived and/or modified sequence opt4 from neuraminidase__InfluenzaA__ACV42010

SEQ ID NO: 169829 - RNA, 1410 nt, Artificial Sequence; identical to SEQ ID NO: 169258
  derived and/or modified sequence opt4 from neuraminidase__InfluenzaA__ACV42020

SEQ ID NO: 169830 - RNA, 1410 nt, Artificial Sequence; identical to SEQ ID NO: 169023
  derived and/or modified sequence opt4 from neuraminidase__InfluenzaA__ACV49504

SEQ ID NO: 169831 - RNA, 1362 nt, Artificial Sequence
  derived and/or modified sequence opt4 from neuraminidase__InfluenzaA__ACV49537
augaaccccaaccagaagaucaucaccaucggcagcaucugcaugguggugggcaucaucagccugauccugcagaucggcaacaucaucagcaucuggaucagccacagcauccagaccggcaaccagaaccacaccggcaucugcaaccagggcaucaucaccuacaacgugguggccggccaggacagcaccagcgugauccugaccggcaacagcagccugugccccaucagaggcugggccauccacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcgccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcaccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaccggcagcugcggccccgugagcgccgacggcgccaacggcgugaagggcuucagcuacagauacggcaacggcguguggaucggcagaaccaagagcgacagcagcagacacggcuucgagaugaucugggaccccaacggcuggaccgagaccgacagcagauucagcgugagacaggacgugguggccaugaccgacagaagcggcuacagcggcagcuucgugcagcaccccgagcugaccggccuggacugcaugagacccugcuucuggguggagcugaucagaggcagacccgaggagaagaccaucuggaccagcggcagcaucaucagcuucugcggcgugaacagcgacaccguggacuggagcuggcccgacggcgccgagcugcccuucaccaucgacaaguga

SEQ ID NO: 169832 - RNA, 1362 nt, Artificial Sequence
  derived and/or modified sequence opt4 from neuraminidase__InfluenzaA__ACV49559
augaaccccaaccagaagaucaucaccaucggcagcaucugcaugguggugggcaucaucagccugauccugcagaucggcaacaucaucagcaucuggaucagccacagcauccaggccggcagcagcaccugggugaaccagaccuacgugaacaucagcaacaccaacgugguggccggccaggacgccaccagcgugauccugaccggcaacagcagccugugccccaucagaggcugggccaucuacagcaaggacaacggcaucagaaucggcagcaagggcgacaucuucgugaucagagagcccuucaucagcugcagccaccuggagugcagagccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccccgccagcuacaagaucuucaagaucgagaagggcaaggugaccaagagcaucgagcuggacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacacccccagacccaaggacggcaccggcagcugcggccccgugagcguggacggcgccaacggcgugaagggcuucagcuacagauacggcgacggcguguggaucggcagaaccaagagccagagcagcagacacggcuucgagaugaucugggaccccaacggcuggaccgagaccgacagcagauucagcgugagacaggacgugguggccaucaccgacuggagcggcuacagcggcagcuucgugcagcaccccgagcugaccggccuggacugcaugagacccugcuucuggguggagcugaucagaggccagcccaaggagaagaccaucuggaccagcggcagcagcaucagcuucugcggcgugaacagcgacaccguggacuggagcuggcccgacggcgccgagcugcccuucaccaucgacaaguga

SEQ ID NO: 169833 - RNA, 1395 nt, Artificial Sequence
  derived and/or modified sequence opt4 from neuraminidase__InfluenzaA__ACV49570
augaaccccaaccagaagaucaucaccaucggcagcaucugcaugguggugggcaucaucagccugauccugcagaucggcaacaucgugagcaucuggaucagccacagcauccagaccggcaaccagaaccacaccggcaccugcgaccagagcaucaucaccuacaagaacagcaccugggugaaccagaccuacgugaacgugguggccggcaaggacaccaccagcgugauccuggccggcaacagcagccugugccccaucagaggcugggccaucuacagcaaggacaacggcgugagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaaggagauccugagaacccaggagagcgagugcgugugcgugaacggcagcugcuucaccaucaugaccgacggccccagcggcggccccgccagcuacaagaucuucaagaucgagaagggcaaggugaccaagagcaucgagcuggacgcccccaacagccacuacgaggagugcagcugcuaccccgacaccagcaaggugaugugcgugugcagagacaacuggcacggcagcaacagacccugggugagcuucgaccagaaccuggacuaccagaugggcuacaucugcagcggcguguucggcgacaaccccagacccaaggacggcaagggcagcugcggccccguguacguggacggcgccaacggcgugaagggcuucagcuacaaguacggcaacggcguguggaucggcagaaccaagagcaacagcagcagacagggcuucgagaugaucugggaccccaacggcuggaccgagaccgacagcaacuucuucaccaagcaggacgugguggccgugaccgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 169834 - RNA, 1410 nt, Artificial Sequence; identical to SEQ ID NO: 168924
  derived and/or modified sequence opt4 from neuraminidase__InfluenzaA__ACV49581

SEQ ID NO: 169835 - RNA, 1410 nt, Artificial Sequence; identical to SEQ ID NO: 168924
  derived and/or modified sequence opt4 from neuraminidase__InfluenzaA__ACV49592

SEQ ID NO: 169836 - RNA, 1410 nt, Artificial Sequence
  derived and/or modified sequence opt4 from neuraminidase__InfluenzaA__ACV49603
augaaccccaaccagaagaucaucaccaucggcagcgugagccugaccaucgagaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 169837 - RNA, 1410 nt, Artificial Sequence
  derived and/or modified sequence opt4 from neuraminidase__InfluenzaA__ACV49625
augaaccccaaccagaagaccaucaccaucggcagcgugagccugaccaucgagaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagaggccccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 169838 - RNA, 1410 nt, Artificial Sequence; identical to SEQ ID NO: 168976
  derived and/or modified sequence opt4 from neuraminidase__InfluenzaA__ACV49647

SEQ ID NO: 169839 - RNA, 1413 nt, Artificial Sequence
  derived and/or modified sequence opt4 from neuraminidase__InfluenzaA__ACV49669
augaaccccaaccagaagaucaucaccaucggcagcaucugcauggccaucggcaucaucagccugauccugcagaucggcaacaucgugagcaucuggaucagccacagcauccagaccggcagccagaacuacaccggcaucugcaaccagagaaucaucaccuacgagaacagcaccugggugaaccagaccuacgugaacaucaacaacaccaacgugguggccggccaggacaccaccagcgugacccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccaacaacggccccgccagcuacaagaucuucaagaucgagaagggcaagaucaccaagagcaucgagcuggacgcccccaacagccacuacgaggagugcagcugcuaccccgacgccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcggccccgugaccguggacggcgccgacggcgugaagggcuucagcuacagauacggcaacggcguguggaucggcagaaccaagagcaacagcagcagaagaggcuucgagaugaucugggaccccaacggcuggaccgacaccgacagcaaguuccuggugaagcaggacgugguggccaugaccgacuggagcggcuacagcggcagcuucgugcagcaccccgagcugaccggccuggacugcaugagacccugcuucuggguggagcugaucagaggcagacccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 169840 - RNA, 1413 nt, Artificial Sequence
  derived and/or modified sequence opt4 from neuraminidase__InfluenzaA__ACV49679
augaaccccaaccagaagaucaucaccaucggcagcaucagcaucgccaucggcaucaucagccugaugcugcagaucggcagcaucaucagcaucugggccagccacagcaucagaaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169841 - RNA, 1410 nt, Artificial Sequence
  derived and/or modified sequence opt4 from neuraminidase__InfluenzaA__ACV53442
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169842 - RNA, 1410 nt, Artificial Sequence; identical to SEQ ID NO: 169625
  derived and/or modified sequence opt4 from neuraminidase__InfluenzaA__ACV53452

SEQ ID NO: 169843 - RNA, 1410 nt, Artificial Sequence; identical to SEQ ID NO: 169248
  derived and/or modified sequence opt4 from neuraminidase__InfluenzaA__ACV53462

SEQ ID NO: 169844 - RNA, 1410 nt, Artificial Sequence; identical to SEQ ID NO: 169258
  derived and/or modified sequence opt4 from neuraminidase__InfluenzaA__ACV53472

SEQ ID NO: 169845 - RNA, 1410 nt, Artificial Sequence
  derived and/or modified sequence opt4 from neuraminidase__InfluenzaA__ACV53482
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcggcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgccaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169846 - RNA, 1410 nt, Artificial Sequence
  derived and/or modified sequence opt4 from neuraminidase__InfluenzaA__ACV53492
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaaggccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacaacuuccugaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169847 - RNA, 1410 nt, Artificial Sequence
  derived and/or modified sequence opt4 from neuraminidase__InfluenzaA__ACV53502
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaaggccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuuccugaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169848 - RNA, 1410 nt, Artificial Sequence
  derived and/or modified sequence opt4 from neuraminidase__InfluenzaA__ACV53891
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaagauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugcgaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169849 - RNA, 1410 nt, Artificial Sequence
  derived and/or modified sequence opt4 from neuraminidase__InfluenzaA__ACV53901
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcagaagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169850 - RNA, 1410 nt, Artificial Sequence; identical to SEQ ID NO: 169258
  derived and/or modified sequence opt4 from neuraminidase__InfluenzaA__ACV53911

SEQ ID NO: 169851 - RNA, 1410 nt, Artificial Sequence; identical to SEQ ID NO: 169248
  derived and/or modified sequence opt4 from neuraminidase__InfluenzaA__ACV67088

SEQ ID NO: 169852 - RNA, 1410 nt, Artificial Sequence; identical to SEQ ID NO: 169258
  derived and/or modified sequence opt4 from neuraminidase__InfluenzaA__ACV67168

SEQ ID NO: 169853 - RNA, 1410 nt, Artificial Sequence; identical to SEQ ID NO: 169248
  derived and/or modified sequence opt4 from neuraminidase__InfluenzaA__ACV67169

SEQ ID NO: 169854 - RNA, 1410 nt, Artificial Sequence; identical to SEQ ID NO: 169258
  derived and/or modified sequence opt4 from neuraminidase__InfluenzaA__ACV67171

SEQ ID NO: 169855 - RNA, 1410 nt, Artificial Sequence; identical to SEQ ID NO: 169258
  derived and/or modified sequence opt4 from neuraminidase__InfluenzaA__ACV67172

SEQ ID NO: 169856 - RNA, 1410 nt, Artificial Sequence; identical to SEQ ID NO: 169288
  derived and/or modified sequence opt4 from neuraminidase__InfluenzaA__ACV67173

SEQ ID NO: 169857 - RNA, 1410 nt, Artificial Sequence; identical to SEQ ID NO: 169248
  derived and/or modified sequence opt4 from neuraminidase__InfluenzaA__ACV67174

SEQ ID NO: 169858 - RNA, 1410 nt, Artificial Sequence
  derived and/or modified sequence opt4 from neuraminidase__InfluenzaA__ACV67175
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcagcaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169859 - RNA, 1410 nt, Artificial Sequence; identical to SEQ ID NO: 169258
  derived and/or modified sequence opt4 from neuraminidase__InfluenzaA__ACV67176

SEQ ID NO: 169860 - RNA, 1410 nt, Artificial Sequence; identical to SEQ ID NO: 169248
  derived and/or modified sequence opt4 from neuraminidase__InfluenzaA__ACV67177

SEQ ID NO: 169861 - RNA, 1410 nt, Artificial Sequence; identical to SEQ ID NO: 169258
  derived and/or modified sequence opt4 from neuraminidase__InfluenzaA__ACV67178

SEQ ID NO: 169862 - RNA, 1410 nt, Artificial Sequence; identical to SEQ ID NO: 169258
  derived and/or modified sequence opt4 from neuraminidase__InfluenzaA__ACV67179

SEQ ID NO: 169863 - RNA, 1410 nt, Artificial Sequence
  derived and/or modified sequence opt4 from neuraminidase__InfluenzaA__ACV67180
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagcccguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169864 - RNA, 1410 nt, Artificial Sequence
  derived and/or modified sequence opt4 from neuraminidase__InfluenzaA__ACV67181
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucaucaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169865 - RNA, 1410 nt, Artificial Sequence; identical to SEQ ID NO: 169682
  derived and/or modified sequence opt4 from neuraminidase__InfluenzaA__ACV67182

SEQ ID NO: 169866 - RNA, 1410 nt, Artificial Sequence
  derived and/or modified sequence opt4 from neuraminidase__InfluenzaA__ACV67183
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcaacgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaacagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169867 - RNA, 1410 nt, Artificial Sequence; identical to SEQ ID NO: 169258
  derived and/or modified sequence opt4 from neuraminidase__InfluenzaA__ACV67184

SEQ ID NO: 169868 - RNA, 1410 nt, Artificial Sequence; identical to SEQ ID NO: 169248
  derived and/or modified sequence opt4 from neuraminidase__InfluenzaA__ACV67186

SEQ ID NO: 169869 - RNA, 1410 nt, Artificial Sequence; identical to SEQ ID NO: 169258
  derived and/or modified sequence opt4 from neuraminidase__InfluenzaA__ACV67187

SEQ ID NO: 169870 - RNA, 1410 nt, Artificial Sequence; identical to SEQ ID NO: 169258
  derived and/or modified sequence opt4 from neuraminidase__InfluenzaA__ACV67188

SEQ ID NO: 169871 - RNA, 1410 nt, Artificial Sequence; identical to SEQ ID NO: 169288
  derived and/or modified sequence opt4 from neuraminidase__InfluenzaA__ACV67189

SEQ ID NO: 169872 - RNA, 1410 nt, Artificial Sequence; identical to SEQ ID NO: 169288
  derived and/or modified sequence opt4 from neuraminidase__InfluenzaA__ACV67190

SEQ ID NO: 169873 - RNA, 1410 nt, Artificial Sequence; identical to SEQ ID NO: 169248
  derived and/or modified sequence opt4 from neuraminidase__InfluenzaA__ACV67191

SEQ ID NO: 169874 - RNA, 1410 nt, Artificial Sequence; identical to SEQ ID NO: 169288
  derived and/or modified sequence opt4 from neuraminidase__InfluenzaA__ACV67192

SEQ ID NO: 169875 - RNA, 1410 nt, Artificial Sequence; identical to SEQ ID NO: 169288
  derived and/or modified sequence opt4 from neuraminidase__InfluenzaA__ACV67193

SEQ ID NO: 169876 - RNA, 1410 nt, Artificial Sequence; identical to SEQ ID NO: 169258
  derived and/or modified sequence opt4 from neuraminidase__InfluenzaA__ACV67194

SEQ ID NO: 169877 - RNA, 1410 nt, Artificial Sequence; identical to SEQ ID NO: 169258
  derived and/or modified sequence opt4 from neuraminidase__InfluenzaA__ACV67195

SEQ ID NO: 169878 - RNA, 1410 nt, Artificial Sequence; identical to SEQ ID NO: 169258
  derived and/or modified sequence opt4 from neuraminidase__InfluenzaA__ACV67196

SEQ ID NO: 169879 - RNA, 1410 nt, Artificial Sequence; identical to SEQ ID NO: 169248
  derived and/or modified sequence opt4 from neuraminidase__InfluenzaA__ACV67197

SEQ ID NO: 169880 - RNA, 1410 nt, Artificial Sequence; identical to SEQ ID NO: 169248
  derived and/or modified sequence opt4 from neuraminidase__InfluenzaA__ACV67199

SEQ ID NO: 169881 - RNA, 1410 nt, Artificial Sequence; identical to SEQ ID NO: 169248
  derived and/or modified sequence opt4 from neuraminidase__InfluenzaA__ACV67200

SEQ ID NO: 169882 - RNA, 1410 nt, Artificial Sequence; identical to SEQ ID NO: 169248
  derived and/or modified sequence opt4 from neuraminidase__InfluenzaA__ACV67201

SEQ ID NO: 169883 - RNA, 1410 nt, Artificial Sequence; identical to SEQ ID NO: 169248
  derived and/or modified sequence opt4 from neuraminidase__InfluenzaA__ACV67202

SEQ ID NO: 169884 - RNA, 1410 nt, Artificial Sequence; identical to SEQ ID NO: 169258
  derived and/or modified sequence opt4 from neuraminidase__InfluenzaA__ACV67203

SEQ ID NO: 169885 - RNA, 1410 nt, Artificial Sequence; identical to SEQ ID NO: 169258
  derived and/or modified sequence opt4 from neuraminidase__InfluenzaA__ACV67204

SEQ ID NO: 169886 - RNA, 1410 nt, Artificial Sequence; identical to SEQ ID NO: 169258
  derived and/or modified sequence opt4 from neuraminidase__InfluenzaA__ACV67205

SEQ ID NO: 169887 - RNA, 1410 nt, Artificial Sequence
  derived and/or modified sequence opt4 from neuraminidase__InfluenzaA__ACV67206
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcauggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169888 - RNA, 1410 nt, Artificial Sequence; identical to SEQ ID NO: 169248
  derived and/or modified sequence opt4 from neuraminidase__InfluenzaA__ACV67207

SEQ ID NO: 169889 - RNA, 1410 nt, Artificial Sequence; identical to SEQ ID NO: 169258
  derived and/or modified sequence opt4 from neuraminidase__InfluenzaA__ACV67208

SEQ ID NO: 169890 - RNA, 1410 nt, Artificial Sequence; identical to SEQ ID NO: 169248
  derived and/or modified sequence opt4 from neuraminidase__InfluenzaA__ACV67210

SEQ ID NO: 169891 - RNA, 1410 nt, Artificial Sequence; identical to SEQ ID NO: 169258
  derived and/or modified sequence opt4 from neuraminidase__InfluenzaA__ACV67211

SEQ ID NO: 169892 - RNA, 1410 nt, Artificial Sequence; identical to SEQ ID NO: 169258
  derived and/or modified sequence opt4 from neuraminidase__InfluenzaA__ACV70076

SEQ ID NO: 169893 - RNA, 1410 nt, Artificial Sequence
  derived and/or modified sequence opt4 from neuraminidase__InfluenzaA__ACV70086
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169894 - RNA, 1410 nt, Artificial Sequence
  derived and/or modified sequence opt4 from neuraminidase__InfluenzaA__ACV70096
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucaccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169895 - RNA, 1410 nt, Artificial Sequence; identical to SEQ ID NO: 169258
  derived and/or modified sequence opt4 from neuraminidase__InfluenzaA__ACV70106

SEQ ID NO: 169896 - RNA, 1410 nt, Artificial Sequence; identical to SEQ ID NO: 169258
  derived and/or modified sequence opt4 from neuraminidase__InfluenzaA__ACV70116

SEQ ID NO: 169897 - RNA, 1410 nt, Artificial Sequence; identical to SEQ ID NO: 169258
  derived and/or modified sequence opt4 from neuraminidase__InfluenzaA__ACV70126

SEQ ID NO: 169898 - RNA, 1410 nt, Artificial Sequence; identical to SEQ ID NO: 169258
  derived and/or modified sequence opt4 from neuraminidase__InfluenzaA__ACV70157

SEQ ID NO: 169899 - RNA, 1410 nt, Artificial Sequence; identical to SEQ ID NO: 169248
  derived and/or modified sequence opt4 from neuraminidase__InfluenzaA__ACV70167

SEQ ID NO: 169900 - RNA, 1410 nt, Artificial Sequence; identical to SEQ ID NO: 169258
  derived and/or modified sequence opt4 from neuraminidase__InfluenzaA__ACV70177

SEQ ID NO: 169901 - RNA, 1410 nt, Artificial Sequence; identical to SEQ ID NO: 169258
  derived and/or modified sequence opt4 from neuraminidase__InfluenzaA__ACV70187

SEQ ID NO: 169902 - RNA, 1410 nt, Artificial Sequence; identical to SEQ ID NO: 169258
  derived and/or modified sequence opt4 from neuraminidase__InfluenzaA__ACV70197

SEQ ID NO: 169903 - RNA, 1410 nt, Artificial Sequence; identical to SEQ ID NO: 169258
  derived and/or modified sequence opt4 from neuraminidase__InfluenzaA__ACV70207

SEQ ID NO: 169904 - RNA, 1410 nt, Artificial Sequence
  derived and/or modified sequence opt4 from neuraminidase__InfluenzaA__ACV70217
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169905 - RNA, 1410 nt, Artificial Sequence; identical to SEQ ID NO: 169258
  derived and/or modified sequence opt4 from neuraminidase__InfluenzaA__ACV70227

SEQ ID NO: 169906 - RNA, 1410 nt, Artificial Sequence; identical to SEQ ID NO: 169258
  derived and/or modified sequence opt4 from neuraminidase__InfluenzaA__ACV70237

SEQ ID NO: 169907 - RNA, 1410 nt, Artificial Sequence; identical to SEQ ID NO: 169258
  derived and/or modified sequence opt4 from neuraminidase__InfluenzaA__ACV70247

SEQ ID NO: 169908 - RNA, 1410 nt, Artificial Sequence; identical to SEQ ID NO: 169258
  derived and/or modified sequence opt4 from neuraminidase__InfluenzaA__ACV70257

SEQ ID NO: 169909 - RNA, 1410 nt, Artificial Sequence; identical to SEQ ID NO: 169258
  derived and/or modified sequence opt4 from neuraminidase__InfluenzaA__ACV70267

SEQ ID NO: 169910 - RNA, 1410 nt, Artificial Sequence; identical to SEQ ID NO: 169258
  derived and/or modified sequence opt4 from neuraminidase__InfluenzaA__ACV70277

SEQ ID NO: 169911 - RNA, 1410 nt, Artificial Sequence; identical to SEQ ID NO: 169258
  derived and/or modified sequence opt4 from neuraminidase__InfluenzaA__ACV70287

SEQ ID NO: 169912 - RNA, 1410 nt, Artificial Sequence; identical to SEQ ID NO: 169258
  derived and/or modified sequence opt4 from neuraminidase__InfluenzaA__ACV70297

SEQ ID NO: 169913 - RNA, 1410 nt, Artificial Sequence; identical to SEQ ID NO: 169258
  derived and/or modified sequence opt4 from neuraminidase__InfluenzaA__ACV70307

SEQ ID NO: 169914 - RNA, 1410 nt, Artificial Sequence; identical to SEQ ID NO: 169248
  derived and/or modified sequence opt4 from neuraminidase__InfluenzaA__ACV70317

SEQ ID NO: 169915 - RNA, 1410 nt, Artificial Sequence; identical to SEQ ID NO: 169258
  derived and/or modified sequence opt4 from neuraminidase__InfluenzaA__ACV70327

SEQ ID NO: 169916 - RNA, 1410 nt, Artificial Sequence; identical to SEQ ID NO: 169258
  derived and/or modified sequence opt4 from neuraminidase__InfluenzaA__ACV70337

SEQ ID NO: 169917 - RNA, 1410 nt, Artificial Sequence; identical to SEQ ID NO: 169258
  derived and/or modified sequence opt4 from neuraminidase__InfluenzaA__ACV70347

SEQ ID NO: 169918 - RNA, 1410 nt, Artificial Sequence; identical to SEQ ID NO: 169258
  derived and/or modified sequence opt4 from neuraminidase__InfluenzaA__ACV70357

SEQ ID NO: 169919 - RNA, 1410 nt, Artificial Sequence; identical to SEQ ID NO: 169258
  derived and/or modified sequence opt4 from neuraminidase__InfluenzaA__ACV70367

SEQ ID NO: 169920 - RNA, 1410 nt, Artificial Sequence; identical to SEQ ID NO: 169258
  derived and/or modified sequence opt4 from neuraminidase__InfluenzaA__ACV70377

SEQ ID NO: 169921 - RNA, 1410 nt, Artificial Sequence; identical to SEQ ID NO: 169258
  derived and/or modified sequence opt4 from neuraminidase__InfluenzaA__ACV70387

SEQ ID NO: 169922 - RNA, 1410 nt, Artificial Sequence; identical to SEQ ID NO: 169258
  derived and/or modified sequence opt4 from neuraminidase__InfluenzaA__ACV70397

SEQ ID NO: 169923 - RNA, 1410 nt, Artificial Sequence; identical to SEQ ID NO: 169258
  derived and/or modified sequence opt4 from neuraminidase__InfluenzaA__ACV70407

SEQ ID NO: 169924 - RNA, 1410 nt, Artificial Sequence; identical to SEQ ID NO: 169248
  derived and/or modified sequence opt4 from neuraminidase__InfluenzaA__ACV70417

SEQ ID NO: 169925 - RNA, 1410 nt, Artificial Sequence; identical to SEQ ID NO: 169258
  derived and/or modified sequence opt4 from neuraminidase__InfluenzaA__ACV70427

SEQ ID NO: 169926 - RNA, 1410 nt, Artificial Sequence; identical to SEQ ID NO: 169258
  derived and/or modified sequence opt4 from neuraminidase__InfluenzaA__ACV70437

SEQ ID NO: 169927 - RNA, 1410 nt, Artificial Sequence; identical to SEQ ID NO: 169258
  derived and/or modified sequence opt4 from neuraminidase__InfluenzaA__ACV70447

SEQ ID NO: 169928 - RNA, 1410 nt, Artificial Sequence; identical to SEQ ID NO: 169258
  derived and/or modified sequence opt4 from neuraminidase__InfluenzaA__ACV70457

SEQ ID NO: 169929 - RNA, 1410 nt, Artificial Sequence; identical to SEQ ID NO: 169258
  derived and/or modified sequence opt4 from neuraminidase__InfluenzaA__ACV70467

SEQ ID NO: 169930 - RNA, 1410 nt, Artificial Sequence; identical to SEQ ID NO: 169258
  derived and/or modified sequence opt4 from neuraminidase__InfluenzaA__ACV70477

SEQ ID NO: 169931 - RNA, 1410 nt, Artificial Sequence; identical to SEQ ID NO: 169258
  derived and/or modified sequence opt4 from neuraminidase__InfluenzaA__ACV70487

SEQ ID NO: 169932 - RNA, 1410 nt, Artificial Sequence; identical to SEQ ID NO: 169258
  derived and/or modified sequence opt4 from neuraminidase__InfluenzaA__ACV70497

SEQ ID NO: 169933 - RNA, 1410 nt, Artificial Sequence; identical to SEQ ID NO: 169258
  derived and/or modified sequence opt4 from neuraminidase__InfluenzaA__ACV70507

SEQ ID NO: 169934 - RNA, 1410 nt, Artificial Sequence; identical to SEQ ID NO: 169258
  derived and/or modified sequence opt4 from neuraminidase__InfluenzaA__ACV70517

SEQ ID NO: 169935 - RNA, 1410 nt, Artificial Sequence; identical to SEQ ID NO: 169258
  derived and/or modified sequence opt4 from neuraminidase__InfluenzaA__ACV70527

SEQ ID NO: 169936 - RNA, 1410 nt, Artificial Sequence; identical to SEQ ID NO: 169258
  derived and/or modified sequence opt4 from neuraminidase__InfluenzaA__ACV70547

SEQ ID NO: 169937 - RNA, 1410 nt, Artificial Sequence; identical to SEQ ID NO: 169258
  derived and/or modified sequence opt4 from neuraminidase__InfluenzaA__ACV70557

SEQ ID NO: 169938 - RNA, 1410 nt, Artificial Sequence; identical to SEQ ID NO: 169258
  derived and/or modified sequence opt4 from neuraminidase__InfluenzaA__ACV70567

SEQ ID NO: 169939 - RNA, 1410 nt, Artificial Sequence; identical to SEQ ID NO: 169258
  derived and/or modified sequence opt4 from neuraminidase__InfluenzaA__ACV70577

SEQ ID NO: 169940 - RNA, 1410 nt, Artificial Sequence; identical to SEQ ID NO: 169258
  derived and/or modified sequence opt4 from neuraminidase__InfluenzaA__ACV70587

SEQ ID NO: 169941 - RNA, 1410 nt, Artificial Sequence; identical to SEQ ID NO: 169248
  derived and/or modified sequence opt4 from neuraminidase__InfluenzaA__ACV70597

SEQ ID NO: 169942 - RNA, 1410 nt, Artificial Sequence; identical to SEQ ID NO: 169258
  derived and/or modified sequence opt4 from neuraminidase__InfluenzaA__ACV70607

SEQ ID NO: 169943 - RNA, 1410 nt, Artificial Sequence; identical to SEQ ID NO: 169841
  derived and/or modified sequence opt4 from neuraminidase__InfluenzaA__ACV70617

SEQ ID NO: 169944 - RNA, 1410 nt, Artificial Sequence; identical to SEQ ID NO: 169258
  derived and/or modified sequence opt4 from neuraminidase__InfluenzaA__ACV70647

SEQ ID NO: 169945 - RNA, 1410 nt, Artificial Sequence; identical to SEQ ID NO: 169258
  derived and/or modified sequence opt4 from neuraminidase__InfluenzaA__ACV70657

SEQ ID NO: 169946 - RNA, 1410 nt, Artificial Sequence; identical to SEQ ID NO: 169258
  derived and/or modified sequence opt4 from neuraminidase__InfluenzaA__ACV70667

SEQ ID NO: 169947 - RNA, 1410 nt, Artificial Sequence; identical to SEQ ID NO: 169258
  derived and/or modified sequence opt4 from neuraminidase__InfluenzaA__ACV70677

SEQ ID NO: 169948 - RNA, 1410 nt, Artificial Sequence; identical to SEQ ID NO: 169258
  derived and/or modified sequence opt4 from neuraminidase__InfluenzaA__ACV70687

SEQ ID NO: 169949 - RNA, 1410 nt, Artificial Sequence; identical to SEQ ID NO: 169258
  derived and/or modified sequence opt4 from neuraminidase__InfluenzaA__ACV70697

SEQ ID NO: 169950 - RNA, 1410 nt, Artificial Sequence; identical to SEQ ID NO: 169258
  derived and/or modified sequence opt4 from neuraminidase__InfluenzaA__ACV70707

SEQ ID NO: 169951 - RNA, 1410 nt, Artificial Sequence; identical to SEQ ID NO: 169258
  derived and/or modified sequence opt4 from neuraminidase__InfluenzaA__ACV70717

SEQ ID NO: 169952 - RNA, 1410 nt, Artificial Sequence; identical to SEQ ID NO: 169258
  derived and/or modified sequence opt4 from neuraminidase__InfluenzaA__ACV70727

SEQ ID NO: 169953 - RNA, 1410 nt, Artificial Sequence; identical to SEQ ID NO: 169258
  derived and/or modified sequence opt4 from neuraminidase__InfluenzaA__ACV70737

SEQ ID NO: 169954 - RNA, 1410 nt, Artificial Sequence; identical to SEQ ID NO: 169258
  derived and/or modified sequence opt4 from neuraminidase__InfluenzaA__ACV70757

SEQ ID NO: 169955 - RNA, 1410 nt, Artificial Sequence; identical to SEQ ID NO: 169258
  derived and/or modified sequence opt4 from neuraminidase__InfluenzaA__ACV70767

SEQ ID NO: 169956 - RNA, 1410 nt, Artificial Sequence; identical to SEQ ID NO: 169258
  derived and/or modified sequence opt4 from neuraminidase__InfluenzaA__ACV70777

SEQ ID NO: 169957 - RNA, 1410 nt, Artificial Sequence; identical to SEQ ID NO: 169258
  derived and/or modified sequence opt4 from neuraminidase__InfluenzaA__ACV70787

SEQ ID NO: 169958 - RNA, 1410 nt, Artificial Sequence; identical to SEQ ID NO: 169258
  derived and/or modified sequence opt4 from neuraminidase__InfluenzaA__ACV70797

SEQ ID NO: 169959 - RNA, 1410 nt, Artificial Sequence; identical to SEQ ID NO: 169258
  derived and/or modified sequence opt4 from neuraminidase__InfluenzaA__ACV70807

SEQ ID NO: 169960 - RNA, 1410 nt, Artificial Sequence; identical to SEQ ID NO: 169258
  derived and/or modified sequence opt4 from neuraminidase__InfluenzaA__ACV70817

SEQ ID NO: 169961 - RNA, 1410 nt, Artificial Sequence; identical to SEQ ID NO: 169248
  derived and/or modified sequence opt4 from neuraminidase__InfluenzaA__ACV70827

SEQ ID NO: 169962 - RNA, 1410 nt, Artificial Sequence; identical to SEQ ID NO: 169258
  derived and/or modified sequence opt4 from neuraminidase__InfluenzaA__ACV70837

SEQ ID NO: 169963 - RNA, 1410 nt, Artificial Sequence
  derived and/or modified sequence opt4 from neuraminidase__InfluenzaA__ACV70847
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaugagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169964 - RNA, 1410 nt, Artificial Sequence; identical to SEQ ID NO: 169258
  derived and/or modified sequence opt4 from neuraminidase__InfluenzaA__ACV70867

SEQ ID NO: 169965 - RNA, 1410 nt, Artificial Sequence; identical to SEQ ID NO: 169258
  derived and/or modified sequence opt4 from neuraminidase__InfluenzaA__ACV70877

SEQ ID NO: 169966 - RNA, 1410 nt, Artificial Sequence
  derived and/or modified sequence opt4 from neuraminidase__InfluenzaA__ACV70887
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcauggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 169967 - RNA, 1410 nt, Artificial Sequence; identical to SEQ ID NO: 169258
  derived and/or modified sequence opt4 from neuraminidase__InfluenzaA__ACV70897

SEQ ID NO: 169968 - RNA, 1410 nt, Artificial Sequence; identical to SEQ ID NO: 169258
  derived and/or modified sequence opt4 from neuraminidase__InfluenzaA__ACV70907

SEQ ID NO: 169969 - RNA, 1410 nt, Artificial Sequence; identical to SEQ ID NO: 169258
  derived and/or modified sequence opt4 from neuraminidase__InfluenzaA__ACV70917

SEQ ID NO: 169970 - RNA, 1410 nt, Artificial Sequence; identical to SEQ ID NO: 169248
  derived and/or modified sequence opt4 from neuraminidase__InfluenzaA__ACV70927

SEQ ID NO: 169971 - RNA, 1410 nt, Artificial Sequence; identical to SEQ ID NO: 169258
  derived and/or modified sequence opt4 from neuraminidase__InfluenzaA__ACV70937

SEQ ID NO: 169972 - RNA, 1410 nt, Artificial Sequence; identical to SEQ ID NO: 169258
  derived and/or modified sequence opt4 from neuraminidase__InfluenzaA__ACV70947

SEQ ID NO: 169973 - RNA, 1410 nt, Artificial Sequence; identical to SEQ ID NO: 169258
  derived and/or modified sequence opt4 from neuraminidase__InfluenzaA__ACV70957

SEQ ID NO: 169974 - RNA, 1410 nt, Artificial Sequence; identical to SEQ ID NO: 169258
  derived and/or modified sequence opt4 from neuraminidase__InfluenzaA__ACV70967

SEQ ID NO: 169975 - RNA, 1410 nt, Artificial Sequence; identical to SEQ ID NO: 169258
  derived and/or modified sequence opt4 from neuraminidase__InfluenzaA__ACV70977

SEQ ID NO: 169976 - RNA, 1410 nt, Artificial Sequence; identical to SEQ ID NO: 169258
  derived and/or modified sequence opt4 from neuraminidase__InfluenzaA__ACV70987

SEQ ID NO: 169977 - RNA, 1410 nt, Artificial Sequence; identical to SEQ ID NO: 169258
  derived and/or modified sequence opt4 from neuraminidase__InfluenzaA__ACV71007

SEQ ID NO: 169978 - RNA, 1410 nt, Artificial Sequence; identical to SEQ ID NO: 169119
  derived and/or modified sequence opt4 from neuraminidase__InfluenzaA__ACV82218

SEQ ID NO: 169979 - RNA, 1410 nt, Artificial Sequence; identical to SEQ ID NO: 169119
  derived and/or modified sequence opt4 from neuraminidase__InfluenzaA__ACV82219

SEQ ID NO: 169980 - RNA, 1410 nt, Artificial Sequence
  derived and/or modified sequence opt4 from neuraminidase__InfluenzaA__ACV82220
augaaccccaaccagaagaucaucaccaucggcagcgugagccugaccaucagcaccaucugcuucuucaugcagcuggccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcuacagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggagaagaccgaggugcuguggaccagcaacagcaucgugguguucugcggcaccagcggcaccuacggcaccggcagcuggcccgacggcgccgacaucaaccugaugcccaucuga

SEQ ID NO: 169981 - RNA, 1413 nt, Artificial Sequence
  derived and/or modified sequence opt4 from neuraminidase__InfluenzaA__ACV82221
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 169982 - RNA, 1410 nt, Artificial Sequence; identical to SEQ ID NO: 169258
  derived and/or modified sequence opt4 from neuraminidase__InfluenzaA__ACV88402

SEQ ID NO: 169983 - RNA, 1410 nt, Artificial Sequence; identical to SEQ ID NO: 169258
  derived and/or modified sequence opt4 from neuraminidase__InfluenzaA__ACV88412

SEQ ID NO: 169984 - RNA, 1410 nt, Artificial Sequence; identical to SEQ ID NO: 169248
  derived and/or modified sequence opt4 from neuraminidase__InfluenzaA__ACV88422

SEQ ID NO: 169985 - RNA, 1365 nt, Artificial Sequence
  derived and/or modified sequence opt4 from neuraminidase__InfluenzaA__ACV89505
augaaccccaaccagaagaucaucaccaucggcagcaucugccugguggugggccugaucagccugauccugcagaucggcaacaucaucagcaucuggaucagccacagcauccagaccggcagccagaaccacaccggcaucugcaaccagaacaucaucaccuacaagaacagcaccugggugaaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcagcggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccgaggacggcaccggcagcugcggccccguguacguggacggcgccaacggcgugaagggcuucagcuacagauacggcaacggcguguggaucggcagaaccaagagccacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaugagacccugcuucuggguggagcugaucagaggcagacccaaggagggcaccaucuggaccagcgccagcagcaucagcuucugcggcgugaacagcgacaccguggacuggagcuggcccgacggcgccgagcugcccuucagcaucgacaaguga

SEQ ID NO: 169986 - RNA, 1410 nt, Artificial Sequence; identical to SEQ ID NO: 169258
  derived and/or modified sequence opt4 from neuraminidase__InfluenzaA__ACV91673

SEQ ID NO: 169987 - RNA, 1410 nt, Artificial Sequence; identical to SEQ ID NO: 169258
  derived and/or modified sequence opt4 from neuraminidase__InfluenzaA__ACV91681

SEQ ID NO: 169988 - RNA, 1410 nt, Artificial Sequence
  derived and/or modified sequence opt4 from neuraminidase__InfluenzaA__ACX31593
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugcugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 169989 - RNA, 1410 nt, Artificial Sequence; identical to SEQ ID NO: 169258
  derived and/or modified sequence opt4 from neuraminidase__InfluenzaA__ACX31901

SEQ ID NO: 169990 - RNA, 1410 nt, Artificial Sequence; identical to SEQ ID NO: 169258
  derived and/or modified sequence opt4 from neuraminidase__InfluenzaA__ACX31902

SEQ ID NO: 169991 - RNA, 1410 nt, Artificial Sequence; identical to SEQ ID NO: 169258
  derived and/or modified sequence opt4 from neuraminidase__InfluenzaA__ACX31905

SEQ ID NO: 169992 - RNA, 1410 nt, Artificial Sequence; identical to SEQ ID NO: 169258
  derived and/or modified sequence opt4 from neuraminidase__InfluenzaA__ACX31906

SEQ ID NO: 169993 - RNA, 1410 nt, Artificial Sequence; identical to SEQ ID NO: 169258
  derived and/or modified sequence opt4 from neuraminidase__InfluenzaA__ACX31907

SEQ ID NO: 169994 - RNA, 1410 nt, Artificial Sequence; identical to SEQ ID NO: 169258
  derived and/or modified sequence opt4 from neuraminidase__InfluenzaA__ACX31908

SEQ ID NO: 169995 - RNA, 1410 nt, Artificial Sequence; identical to SEQ ID NO: 169413
  derived and/or modified sequence opt4 from neuraminidase__InfluenzaA__ACX31909

SEQ ID NO: 169996 - RNA, 1410 nt, Artificial Sequence; identical to SEQ ID NO: 169258
  derived and/or modified sequence opt4 from neuraminidase__InfluenzaA__ACX31911

SEQ ID NO: 169997 - RNA, 1410 nt, Artificial Sequence; identical to SEQ ID NO: 169258
  derived and/or modified sequence opt4 from neuraminidase__InfluenzaA__ACX31912

SEQ ID NO: 169998 - RNA, 1410 nt, Artificial Sequence; identical to SEQ ID NO: 169258
  derived and/or modified sequence opt4 from neuraminidase__InfluenzaA__ACX31913

SEQ ID NO: 169999 - RNA, 1410 nt, Artificial Sequence; identical to SEQ ID NO: 169258
  derived and/or modified sequence opt4 from neuraminidase__InfluenzaA__ACX31914

SEQ ID NO: 170000 - RNA, 1410 nt, Artificial Sequence; identical to SEQ ID NO: 169258
  derived and/or modified sequence opt4 from neuraminidase__InfluenzaA__ACX31915

SEQ ID NO: 170001 - RNA, 1410 nt, Artificial Sequence; identical to SEQ ID NO: 169258
  derived and/or modified sequence opt4 from neuraminidase__InfluenzaA__ACX31916

SEQ ID NO: 170002 - RNA, 1410 nt, Artificial Sequence
  derived and/or modified sequence opt4 from neuraminidase__InfluenzaA__ACX31917
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaccgacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170003 - RNA, 1410 nt, Artificial Sequence; identical to SEQ ID NO: 169258
  derived and/or modified sequence opt4 from neuraminidase__InfluenzaA__ACX31918

SEQ ID NO: 170004 - RNA, 1410 nt, Artificial Sequence; identical to SEQ ID NO: 169258
  derived and/or modified sequence opt4 from neuraminidase__InfluenzaA__ACX31919

SEQ ID NO: 170005 - RNA, 1410 nt, Artificial Sequence; identical to SEQ ID NO: 169258
  derived and/or modified sequence opt4 from neuraminidase__InfluenzaA__ACX31920

SEQ ID NO: 170006 - RNA, 1410 nt, Artificial Sequence; identical to SEQ ID NO: 169612
  derived and/or modified sequence opt4 from neuraminidase__InfluenzaA__ACX31922

SEQ ID NO: 170007 - RNA, 1410 nt, Artificial Sequence; identical to SEQ ID NO: 169258
  derived and/or modified sequence opt4 from neuraminidase__InfluenzaA__ACX31923

SEQ ID NO: 170008 - RNA, 1410 nt, Artificial Sequence; identical to SEQ ID NO: 169248
  derived and/or modified sequence opt4 from neuraminidase__InfluenzaA__ACX31924

SEQ ID NO: 170009 - RNA, 1410 nt, Artificial Sequence
  derived and/or modified sequence opt4 from neuraminidase__InfluenzaA__ACX31925
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucacccugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaucaucgacaaguga

SEQ ID NO: 170010 - RNA, 1410 nt, Artificial Sequence; identical to SEQ ID NO: 169258
  derived and/or modified sequence opt4 from neuraminidase__InfluenzaA__ACX31926

SEQ ID NO: 170011 - RNA, 1410 nt, Artificial Sequence; identical to SEQ ID NO: 169258
  derived and/or modified sequence opt4 from neuraminidase__InfluenzaA__ACX31927

SEQ ID NO: 170012 - RNA, 1410 nt, Artificial Sequence
  derived and/or modified sequence opt4 from neuraminidase__InfluenzaA__ACX31928
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgagaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacggcgacaccgugggcuggagcuggcccgacggcgccgagcugcccuucaccaucgacaaguga

SEQ ID NO: 170013 - RNA, 1410 nt, Artificial Sequence; identical to SEQ ID NO: 169288
  derived and/or modified sequence opt4 from neuraminidase__InfluenzaA__ACX31929

SEQ ID NO: 170014 - RNA, 1410 nt, Artificial Sequence; identical to SEQ ID NO: 169612
  derived and/or modified sequence opt4 from neuraminidase__InfluenzaA__ACX31930

SEQ ID NO: 170015 - RNA, 1410 nt, Artificial Sequence; identical to SEQ ID NO: 169258
  derived and/or modified sequence opt4 from neuraminidase__InfluenzaA__ACX31931

SEQ ID NO: 170016 - RNA, 1410 nt, Artificial Sequence; identical to SEQ ID NO: 169258
  derived and/or modified sequence opt4 from neuraminidase__InfluenzaA__ACX31932

SEQ ID NO: 170017 - RNA, 1410 nt, Artificial Sequence; identical to SEQ ID NO: 169258
  derived and/or modified sequence opt4 from neuraminidase__InfluenzaA__ACX35250

SEQ ID NO: 170018 - RNA, 1410 nt, Artificial Sequence; identical to SEQ ID NO: 169258
  derived and/or modified sequence opt4 from neuraminidase__InfluenzaA__ACX35260

SEQ ID NO: 170019 - RNA, 1410 nt, Artificial Sequence; identical to SEQ ID NO: 169258
  derived and/or modified sequence opt4 from neuraminidase__InfluenzaA__ACX35270

SEQ ID NO: 170020 - RNA, 1410 nt, Artificial Sequence
  derived and/or modified sequence opt4 from neuraminidase__InfluenzaA__ACX35280
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggacaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170021 - RNA, 1410 nt, Artificial Sequence; identical to SEQ ID NO: 169258
  derived and/or modified sequence opt4 from neuraminidase__InfluenzaA__ACX35290

SEQ ID NO: 170022 - RNA, 1410 nt, Artificial Sequence; identical to SEQ ID NO: 169258
  derived and/or modified sequence opt4 from neuraminidase__InfluenzaA__ACX35300

SEQ ID NO: 170023 - RNA, 1410 nt, Artificial Sequence
  derived and/or modified sequence opt4 from neuraminidase__InfluenzaA__ACX35310
augaaccccaaccagaagaucaucaccaucggcagcgugugcaugaccaucggcauggccaaccugauccugcagaucggcaacaucaucagcaucuggaucagccacagcauccagcugggcaaccagaaccagaucggcaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170024 - RNA, 1410 nt, Artificial Sequence; identical to SEQ ID NO: 169258
  derived and/or modified sequence opt4 from neuraminidase__InfluenzaA__ACX35320

SEQ ID NO: 170025 - RNA, 1410 nt, Artificial Sequence
  derived and/or modified sequence opt4 from neuraminidase__InfluenzaA__ACX35330
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170026 - RNA, 1410 nt, Artificial Sequence; identical to SEQ ID NO: 169258
  derived and/or modified sequence opt4 from neuraminidase__InfluenzaA__ACX48479

SEQ ID NO: 170027 - RNA, 1410 nt, Artificial Sequence; identical to SEQ ID NO: 169258
  derived and/or modified sequence opt4 from neuraminidase__InfluenzaA__ACX48481

SEQ ID NO: 170028 - RNA, 1410 nt, Artificial Sequence; identical to SEQ ID NO: 169258
  derived and/or modified sequence opt4 from neuraminidase__InfluenzaA__ACX55836

SEQ ID NO: 170029 - RNA, 1410 nt, Artificial Sequence
  derived and/or modified sequence opt4 from neuraminidase__InfluenzaA__ACX56269
augaaccccaagcagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170030 - RNA, 1410 nt, Artificial Sequence
  derived and/or modified sequence opt4 from neuraminidase__InfluenzaA__ACX56270
augaaccccaagcagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacagcgugagcuggagcuggcccgacggcgccgagcugcccuucaccaucgacaaguga

SEQ ID NO: 170031 - RNA, 1410 nt, Artificial Sequence
  derived and/or modified sequence opt4 from neuraminidase__InfluenzaA__ACX56271
augaaccccaagcagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaaccuggccgccggccagagcgugggcagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170032 - RNA, 1410 nt, Artificial Sequence; identical to SEQ ID NO: 169258
  derived and/or modified sequence opt4 from neuraminidase__InfluenzaA__ACX83579

SEQ ID NO: 170033 - RNA, 1410 nt, Artificial Sequence; identical to SEQ ID NO: 169258
  derived and/or modified sequence opt4 from neuraminidase__InfluenzaA__ACX85425

SEQ ID NO: 170034 - RNA, 1410 nt, Artificial Sequence; identical to SEQ ID NO: 169258
  derived and/or modified sequence opt4 from neuraminidase__InfluenzaA__ACX85426

SEQ ID NO: 170035 - RNA, 1410 nt, Artificial Sequence
  derived and/or modified sequence opt4 from neuraminidase__InfluenzaA__ACY02998
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcggcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170036 - RNA, 1410 nt, Artificial Sequence; identical to SEQ ID NO: 169258
  derived and/or modified sequence opt4 from neuraminidase__InfluenzaA__ACY03005

SEQ ID NO: 170037 - RNA, 1410 nt, Artificial Sequence; identical to SEQ ID NO: 169258
  derived and/or modified sequence opt4 from neuraminidase__InfluenzaA__ACY03008

SEQ ID NO: 170038 - RNA, 1410 nt, Artificial Sequence; identical to SEQ ID NO: 169258
  derived and/or modified sequence opt4 from neuraminidase__InfluenzaA__ACY03011

SEQ ID NO: 170039 - RNA, 1410 nt, Artificial Sequence; identical to SEQ ID NO: 169258
  derived and/or modified sequence opt4 from neuraminidase__InfluenzaA__ACY03012

SEQ ID NO: 170040 - RNA, 1410 nt, Artificial Sequence; identical to SEQ ID NO: 169258
  derived and/or modified sequence opt4 from neuraminidase__InfluenzaA__ACY03016

SEQ ID NO: 170041 - RNA, 1410 nt, Artificial Sequence; identical to SEQ ID NO: 169258
  derived and/or modified sequence opt4 from neuraminidase__InfluenzaA__ACY26194

SEQ ID NO: 170042 - RNA, 1410 nt, Artificial Sequence; identical to SEQ ID NO: 169258
  derived and/or modified sequence opt4 from neuraminidase__InfluenzaA__ACY26204

SEQ ID NO: 170043 - RNA, 1410 nt, Artificial Sequence; identical to SEQ ID NO: 169258
  derived and/or modified sequence opt4 from neuraminidase__InfluenzaA__ACY30123

SEQ ID NO: 170044 - RNA, 1410 nt, Artificial Sequence; identical to SEQ ID NO: 169258
  derived and/or modified sequence opt4 from neuraminidase__InfluenzaA__ACY30124

SEQ ID NO: 170045 - RNA, 1410 nt, Artificial Sequence; identical to SEQ ID NO: 169258
  derived and/or modified sequence opt4 from neuraminidase__InfluenzaA__ACY30125

SEQ ID NO: 170046 - RNA, 1410 nt, Artificial Sequence; identical to SEQ ID NO: 169258
  derived and/or modified sequence opt4 from neuraminidase__InfluenzaA__ACY30127

SEQ ID NO: 170047 - RNA, 1410 nt, Artificial Sequence; identical to SEQ ID NO: 169258
  derived and/or modified sequence opt4 from neuraminidase__InfluenzaA__ACY30128

SEQ ID NO: 170048 - RNA, 1410 nt, Artificial Sequence; identical to SEQ ID NO: 169258
  derived and/or modified sequence opt4 from neuraminidase__InfluenzaA__ACY46105

SEQ ID NO: 170049 - RNA, 1410 nt, Artificial Sequence; identical to SEQ ID NO: 169258
  derived and/or modified sequence opt4 from neuraminidase__InfluenzaA__ACY46165

SEQ ID NO: 170050 - RNA, 1410 nt, Artificial Sequence; identical to SEQ ID NO: 169258
  derived and/or modified sequence opt4 from neuraminidase__InfluenzaA__ACY46175

SEQ ID NO: 170051 - RNA, 1410 nt, Artificial Sequence; identical to SEQ ID NO: 169258
  derived and/or modified sequence opt4 from neuraminidase__InfluenzaA__ACY46345

SEQ ID NO: 170052 - RNA, 1410 nt, Artificial Sequence; identical to SEQ ID NO: 169258
  derived and/or modified sequence opt4 from neuraminidase__InfluenzaA__ACY46385

SEQ ID NO: 170053 - RNA, 1410 nt, Artificial Sequence; identical to SEQ ID NO: 169258
  derived and/or modified sequence opt4 from neuraminidase__InfluenzaA__ACY46485

SEQ ID NO: 170054 - RNA, 1410 nt, Artificial Sequence; identical to SEQ ID NO: 169288
  derived and/or modified sequence opt4 from neuraminidase__InfluenzaA__ACY77536

SEQ ID NO: 170055 - RNA, 1410 nt, Artificial Sequence; identical to SEQ ID NO: 169248
  derived and/or modified sequence opt4 from neuraminidase__InfluenzaA__ACY77546

SEQ ID NO: 170056 - RNA, 1410 nt, Artificial Sequence; identical to SEQ ID NO: 169288
  derived and/or modified sequence opt4 from neuraminidase__InfluenzaA__ACY77565

SEQ ID NO: 170057 - RNA, 1410 nt, Artificial Sequence
  derived and/or modified sequence opt4 from neuraminidase__InfluenzaA__ACY77575
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccagcgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170058 - RNA, 1410 nt, Artificial Sequence; identical to SEQ ID NO: 169258
  derived and/or modified sequence opt4 from neuraminidase__InfluenzaA__ACY77585

SEQ ID NO: 170059 - RNA, 1410 nt, Artificial Sequence; identical to SEQ ID NO: 169288
  derived and/or modified sequence opt4 from neuraminidase__InfluenzaA__ACY77595

SEQ ID NO: 170060 - RNA, 1410 nt, Artificial Sequence; identical to SEQ ID NO: 169288
  derived and/or modified sequence opt4 from neuraminidase__InfluenzaA__ACY77605

SEQ ID NO: 170061 - RNA, 1410 nt, Artificial Sequence; identical to SEQ ID NO: 169258
  derived and/or modified sequence opt4 from neuraminidase__InfluenzaA__ACY77625

SEQ ID NO: 170062 - RNA, 1410 nt, Artificial Sequence
  derived and/or modified sequence opt4 from neuraminidase__InfluenzaA__ACY77655
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcuucaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170063 - RNA, 1410 nt, Artificial Sequence; identical to SEQ ID NO: 169258
  derived and/or modified sequence opt4 from neuraminidase__InfluenzaA__ACY77665

SEQ ID NO: 170064 - RNA, 1410 nt, Artificial Sequence; identical to SEQ ID NO: 169258
  derived and/or modified sequence opt4 from neuraminidase__InfluenzaA__ACY77675

SEQ ID NO: 170065 - RNA, 1410 nt, Artificial Sequence; identical to SEQ ID NO: 169248
  derived and/or modified sequence opt4 from neuraminidase__InfluenzaA__ACY77685

SEQ ID NO: 170066 - RNA, 1410 nt, Artificial Sequence; identical to SEQ ID NO: 169248
  derived and/or modified sequence opt4 from neuraminidase__InfluenzaA__ACY77695

SEQ ID NO: 170067 - RNA, 1410 nt, Artificial Sequence; identical to SEQ ID NO: 169248
  derived and/or modified sequence opt4 from neuraminidase__InfluenzaA__ACY77705

SEQ ID NO: 170068 - RNA, 1410 nt, Artificial Sequence; identical to SEQ ID NO: 169248
  derived and/or modified sequence opt4 from neuraminidase__InfluenzaA__ACY77725

SEQ ID NO: 170069 - RNA, 1410 nt, Artificial Sequence; identical to SEQ ID NO: 169248
  derived and/or modified sequence opt4 from neuraminidase__InfluenzaA__ACY77735

SEQ ID NO: 170070 - RNA, 1410 nt, Artificial Sequence; identical to SEQ ID NO: 169258
  derived and/or modified sequence opt4 from neuraminidase__InfluenzaA__ACY77745

SEQ ID NO: 170071 - RNA, 1410 nt, Artificial Sequence; identical to SEQ ID NO: 169258
  derived and/or modified sequence opt4 from neuraminidase__InfluenzaA__ACY77755

SEQ ID NO: 170072 - RNA, 1410 nt, Artificial Sequence; identical to SEQ ID NO: 169258
  derived and/or modified sequence opt4 from neuraminidase__InfluenzaA__ACY77775

SEQ ID NO: 170073 - RNA, 1410 nt, Artificial Sequence; identical to SEQ ID NO: 169258
  derived and/or modified sequence opt4 from neuraminidase__InfluenzaA__ACY77785

SEQ ID NO: 170074 - RNA, 1410 nt, Artificial Sequence; identical to SEQ ID NO: 169258
  derived and/or modified sequence opt4 from neuraminidase__InfluenzaA__ACY77795

SEQ ID NO: 170075 - RNA, 1410 nt, Artificial Sequence
  derived and/or modified sequence opt4 from neuraminidase__InfluenzaA__ACY77825
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgccaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaacagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170076 - RNA, 1410 nt, Artificial Sequence; identical to SEQ ID NO: 170075
  derived and/or modified sequence opt4 from neuraminidase__InfluenzaA__ACY77835

SEQ ID NO: 170077 - RNA, 1410 nt, Artificial Sequence; identical to SEQ ID NO: 169288
  derived and/or modified sequence opt4 from neuraminidase__InfluenzaA__ACY77845

SEQ ID NO: 170078 - RNA, 1410 nt, Artificial Sequence; identical to SEQ ID NO: 169258
  derived and/or modified sequence opt4 from neuraminidase__InfluenzaA__ACY77865

SEQ ID NO: 170079 - RNA, 1410 nt, Artificial Sequence
  derived and/or modified sequence opt4 from neuraminidase__InfluenzaA__ACY77870
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaaccuggccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170080 - RNA, 1410 nt, Artificial Sequence; identical to SEQ ID NO: 169258
  derived and/or modified sequence opt4 from neuraminidase__InfluenzaA__ACY77877

SEQ ID NO: 170081 - RNA, 1410 nt, Artificial Sequence; identical to SEQ ID NO: 169258
  derived and/or modified sequence opt4 from neuraminidase__InfluenzaA__ACY77887

SEQ ID NO: 170082 - RNA, 1410 nt, Artificial Sequence; identical to SEQ ID NO: 169258
  derived and/or modified sequence opt4 from neuraminidase__InfluenzaA__ACY77907

SEQ ID NO: 170083 - RNA, 1410 nt, Artificial Sequence; identical to SEQ ID NO: 169288
  derived and/or modified sequence opt4 from neuraminidase__InfluenzaA__ACY77917

SEQ ID NO: 170084 - RNA, 1410 nt, Artificial Sequence
  derived and/or modified sequence opt4 from neuraminidase__InfluenzaA__ACY77927
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccaacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170085 - RNA, 1410 nt, Artificial Sequence; identical to SEQ ID NO: 169258
  derived and/or modified sequence opt4 from neuraminidase__InfluenzaA__ACY77937

SEQ ID NO: 170086 - RNA, 1410 nt, Artificial Sequence; identical to SEQ ID NO: 169258
  derived and/or modified sequence opt4 from neuraminidase__InfluenzaA__ACY77947

SEQ ID NO: 170087 - RNA, 1410 nt, Artificial Sequence; identical to SEQ ID NO: 169258
  derived and/or modified sequence opt4 from neuraminidase__InfluenzaA__ACY77967

SEQ ID NO: 170088 - RNA, 1410 nt, Artificial Sequence; identical to SEQ ID NO: 169248
  derived and/or modified sequence opt4 from neuraminidase__InfluenzaA__ACY77977

SEQ ID NO: 170089 - RNA, 1410 nt, Artificial Sequence; identical to SEQ ID NO: 169258
  derived and/or modified sequence opt4 from neuraminidase__InfluenzaA__ACY77987

SEQ ID NO: 170090 - RNA, 1410 nt, Artificial Sequence
  derived and/or modified sequence opt4 from neuraminidase__InfluenzaA__ACY77997
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugacccuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170091 - RNA, 1410 nt, Artificial Sequence; identical to SEQ ID NO: 169258
  derived and/or modified sequence opt4 from neuraminidase__InfluenzaA__ACY78017

SEQ ID NO: 170092 - RNA, 1410 nt, Artificial Sequence
  derived and/or modified sequence opt4 from neuraminidase__InfluenzaA__ACZ01955
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccggcaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170093 - RNA, 1410 nt, Artificial Sequence; identical to SEQ ID NO: 169258
  derived and/or modified sequence opt4 from neuraminidase__InfluenzaA__ACZ05053

SEQ ID NO: 170094 - RNA, 1410 nt, Artificial Sequence; identical to SEQ ID NO: 169248
  derived and/or modified sequence opt4 from neuraminidase__InfluenzaA__ACZ05064

SEQ ID NO: 170095 - RNA, 1410 nt, Artificial Sequence; identical to SEQ ID NO: 169258
  derived and/or modified sequence opt4 from neuraminidase__InfluenzaA__ACZ05074

SEQ ID NO: 170096 - RNA, 1410 nt, Artificial Sequence; identical to SEQ ID NO: 169258
  derived and/or modified sequence opt4 from neuraminidase__InfluenzaA__ACZ05084

SEQ ID NO: 170097 - RNA, 1410 nt, Artificial Sequence; identical to SEQ ID NO: 169258
  derived and/or modified sequence opt4 from neuraminidase__InfluenzaA__ACZ05094

SEQ ID NO: 170098 - RNA, 1410 nt, Artificial Sequence; identical to SEQ ID NO: 169258
  derived and/or modified sequence opt4 from neuraminidase__InfluenzaA__ACZ05104

SEQ ID NO: 170099 - RNA, 1410 nt, Artificial Sequence; identical to SEQ ID NO: 169258
  derived and/or modified sequence opt4 from neuraminidase__InfluenzaA__ACZ05114

SEQ ID NO: 170100 - RNA, 1410 nt, Artificial Sequence; identical to SEQ ID NO: 169258
  derived and/or modified sequence opt4 from neuraminidase__InfluenzaA__ACZ05124

SEQ ID NO: 170101 - RNA, 1410 nt, Artificial Sequence; identical to SEQ ID NO: 169258
  derived and/or modified sequence opt4 from neuraminidase__InfluenzaA__ACZ05144

SEQ ID NO: 170102 - RNA, 1410 nt, Artificial Sequence; identical to SEQ ID NO: 169258
  derived and/or modified sequence opt4 from neuraminidase__InfluenzaA__ACZ05154

SEQ ID NO: 170103 - RNA, 1410 nt, Artificial Sequence; identical to SEQ ID NO: 169119
  derived and/or modified sequence opt4 from neuraminidase__InfluenzaA__ACZ05164

SEQ ID NO: 170104 - RNA, 1410 nt, Artificial Sequence; identical to SEQ ID NO: 169119
  derived and/or modified sequence opt4 from neuraminidase__InfluenzaA__ACZ05175

SEQ ID NO: 170105 - RNA, 1413 nt, Artificial Sequence
  derived and/or modified sequence opt4 from neuraminidase__InfluenzaA__ACZ05197
augaaccccaaccagaagaucaugaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170106 - RNA, 1410 nt, Artificial Sequence
  derived and/or modified sequence opt4 from neuraminidase__InfluenzaA__ACZ05208
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugcagcgaccccaacaacgaggagggcggccacggcgugaagggcugggccuucgacagcggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 170107 - RNA, 1410 nt, Artificial Sequence
  derived and/or modified sequence opt4 from neuraminidase__InfluenzaA__ACZ05219
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 170108 - RNA, 1410 nt, Artificial Sequence; identical to SEQ ID NO: 169119
  derived and/or modified sequence opt4 from neuraminidase__InfluenzaA__ACZ05230

SEQ ID NO: 170109 - RNA, 1410 nt, Artificial Sequence
  derived and/or modified sequence opt4 from neuraminidase__InfluenzaA__ACZ05241
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 170110 - RNA, 1413 nt, Artificial Sequence
  derived and/or modified sequence opt4 from neuraminidase__InfluenzaA__ACZ05296
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccguggccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170111 - RNA, 1410 nt, Artificial Sequence; identical to SEQ ID NO: 169119
  derived and/or modified sequence opt4 from neuraminidase__InfluenzaA__ACZ05307

SEQ ID NO: 170112 - RNA, 1410 nt, Artificial Sequence
  derived and/or modified sequence opt4 from neuraminidase__InfluenzaA__ACZ05318
augaaccccaaccagaagaucaucaccaucggcagcgugagccugaccaucagcaccaucugcuucuucaugcagaccgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 170113 - RNA, 1410 nt, Artificial Sequence; identical to SEQ ID NO: 169119
  derived and/or modified sequence opt4 from neuraminidase__InfluenzaA__ACZ05329

SEQ ID NO: 170114 - RNA, 1410 nt, Artificial Sequence; identical to SEQ ID NO: 169032
  derived and/or modified sequence opt4 from neuraminidase__InfluenzaA__ACZ05340

SEQ ID NO: 170115 - RNA, 1410 nt, Artificial Sequence; identical to SEQ ID NO: 170109
  derived and/or modified sequence opt4 from neuraminidase__InfluenzaA__ACZ05362

SEQ ID NO: 170116 - RNA, 1410 nt, Artificial Sequence; identical to SEQ ID NO: 169119
  derived and/or modified sequence opt4 from neuraminidase__InfluenzaA__ACZ05373

SEQ ID NO: 170117 - RNA, 1410 nt, Artificial Sequence; identical to SEQ ID NO: 169119
  derived and/or modified sequence opt4 from neuraminidase__InfluenzaA__ACZ05395

SEQ ID NO: 170118 - RNA, 1410 nt, Artificial Sequence; identical to SEQ ID NO: 169119
  derived and/or modified sequence opt4 from neuraminidase__InfluenzaA__ACZ05406

SEQ ID NO: 170119 - RNA, 1413 nt, Artificial Sequence
  derived and/or modified sequence opt4 from neuraminidase__InfluenzaA__ACZ05450
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcgugagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170120 - RNA, 1410 nt, Artificial Sequence; identical to SEQ ID NO: 169119
  derived and/or modified sequence opt4 from neuraminidase__InfluenzaA__ACZ05461

SEQ ID NO: 170121 - RNA, 1410 nt, Artificial Sequence; identical to SEQ ID NO: 169119
  derived and/or modified sequence opt4 from neuraminidase__InfluenzaA__ACZ05472

SEQ ID NO: 170122 - RNA, 1410 nt, Artificial Sequence
  derived and/or modified sequence opt4 from neuraminidase__InfluenzaA__ACZ05483
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccguggagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 170123 - RNA, 1410 nt, Artificial Sequence; identical to SEQ ID NO: 169119
  derived and/or modified sequence opt4 from neuraminidase__InfluenzaA__ACZ05494

SEQ ID NO: 170124 - RNA, 1410 nt, Artificial Sequence; identical to SEQ ID NO: 170112
  derived and/or modified sequence opt4 from neuraminidase__InfluenzaA__ACZ05516

SEQ ID NO: 170125 - RNA, 1410 nt, Artificial Sequence
  derived and/or modified sequence opt4 from neuraminidase__InfluenzaA__ACZ05527
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugcagcgaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 170126 - RNA, 1410 nt, Artificial Sequence; identical to SEQ ID NO: 170109
  derived and/or modified sequence opt4 from neuraminidase__InfluenzaA__ACZ05538

SEQ ID NO: 170127 - RNA, 1413 nt, Artificial Sequence; identical to SEQ ID NO: 169981
  derived and/or modified sequence opt4 from neuraminidase__InfluenzaA__ACZ05593

SEQ ID NO: 170128 - RNA, 1413 nt, Artificial Sequence
  derived and/or modified sequence opt4 from neuraminidase__InfluenzaA__ACZ05604
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170129 - RNA, 1410 nt, Artificial Sequence; identical to SEQ ID NO: 169119
  derived and/or modified sequence opt4 from neuraminidase__InfluenzaA__ACZ05953

SEQ ID NO: 170130 - RNA, 1410 nt, Artificial Sequence; identical to SEQ ID NO: 170125
  derived and/or modified sequence opt4 from neuraminidase__InfluenzaA__ACZ05964

SEQ ID NO: 170131 - RNA, 1410 nt, Artificial Sequence; identical to SEQ ID NO: 169119
  derived and/or modified sequence opt4 from neuraminidase__InfluenzaA__ACZ05997

SEQ ID NO: 170132 - RNA, 1410 nt, Artificial Sequence; identical to SEQ ID NO: 170125
  derived and/or modified sequence opt4 from neuraminidase__InfluenzaA__ACZ06008

SEQ ID NO: 170133 - RNA, 1410 nt, Artificial Sequence; identical to SEQ ID NO: 170125
  derived and/or modified sequence opt4 from neuraminidase__InfluenzaA__ACZ06019

SEQ ID NO: 170134 - RNA, 1413 nt, Artificial Sequence
  derived and/or modified sequence opt4 from neuraminidase__InfluenzaA__ACZ16015
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugagcaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170135 - RNA, 1413 nt, Artificial Sequence
  derived and/or modified sequence opt4 from neuraminidase__InfluenzaA__ACZ16025
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170136 - RNA, 1413 nt, Artificial Sequence; identical to SEQ ID NO: 169981
  derived and/or modified sequence opt4 from neuraminidase__InfluenzaA__ACZ16035

SEQ ID NO: 170137 - RNA, 1410 nt, Artificial Sequence
  derived and/or modified sequence opt4 from neuraminidase__InfluenzaA__ACZ16043
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacaacaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170138 - RNA, 1410 nt, Artificial Sequence
  derived and/or modified sequence opt4 from neuraminidase__InfluenzaA__ACZ16053
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaccaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170139 - RNA, 1410 nt, Artificial Sequence; identical to SEQ ID NO: 169248
  derived and/or modified sequence opt4 from neuraminidase__InfluenzaA__ACZ16073

SEQ ID NO: 170140 - RNA, 1410 nt, Artificial Sequence
  derived and/or modified sequence opt4 from neuraminidase__InfluenzaA__ACZ16083
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccagacagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccugggcugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggaucgagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170141 - RNA, 1410 nt, Artificial Sequence; identical to SEQ ID NO: 169248
  derived and/or modified sequence opt4 from neuraminidase__InfluenzaA__ACZ16093

SEQ ID NO: 170142 - RNA, 1410 nt, Artificial Sequence; identical to SEQ ID NO: 169258
  derived and/or modified sequence opt4 from neuraminidase__InfluenzaA__ACZ16103

SEQ ID NO: 170143 - RNA, 1410 nt, Artificial Sequence; identical to SEQ ID NO: 169258
  derived and/or modified sequence opt4 from neuraminidase__InfluenzaA__ACZ16113

SEQ ID NO: 170144 - RNA, 1410 nt, Artificial Sequence; identical to SEQ ID NO: 169258
  derived and/or modified sequence opt4 from neuraminidase__InfluenzaA__ACZ16123

SEQ ID NO: 170145 - RNA, 1410 nt, Artificial Sequence
  derived and/or modified sequence opt4 from neuraminidase__InfluenzaA__ACZ16133
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170146 - RNA, 1410 nt, Artificial Sequence
  derived and/or modified sequence opt4 from neuraminidase__InfluenzaA__ACZ16143
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggcccccugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170147 - RNA, 1410 nt, Artificial Sequence; identical to SEQ ID NO: 169258
  derived and/or modified sequence opt4 from neuraminidase__InfluenzaA__ACZ16153

SEQ ID NO: 170148 - RNA, 1410 nt, Artificial Sequence; identical to SEQ ID NO: 169258
  derived and/or modified sequence opt4 from neuraminidase__InfluenzaA__ACZ16163

SEQ ID NO: 170149 - RNA, 1410 nt, Artificial Sequence; identical to SEQ ID NO: 169248
  derived and/or modified sequence opt4 from neuraminidase__InfluenzaA__ACZ16173

SEQ ID NO: 170150 - RNA, 1410 nt, Artificial Sequence; identical to SEQ ID NO: 169258
  derived and/or modified sequence opt4 from neuraminidase__InfluenzaA__ACZ16193

SEQ ID NO: 170151 - RNA, 1410 nt, Artificial Sequence; identical to SEQ ID NO: 169258
  derived and/or modified sequence opt4 from neuraminidase__InfluenzaA__ACZ16203

SEQ ID NO: 170152 - RNA, 1410 nt, Artificial Sequence; identical to SEQ ID NO: 169258
  derived and/or modified sequence opt4 from neuraminidase__InfluenzaA__ACZ16213

SEQ ID NO: 170153 - RNA, 1410 nt, Artificial Sequence
  derived and/or modified sequence opt4 from neuraminidase__InfluenzaA__ACZ16223
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacgagaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170154 - RNA, 1410 nt, Artificial Sequence; identical to SEQ ID NO: 169258
  derived and/or modified sequence opt4 from neuraminidase__InfluenzaA__ACZ16233

SEQ ID NO: 170155 - RNA, 1410 nt, Artificial Sequence; identical to SEQ ID NO: 169966
  derived and/or modified sequence opt4 from neuraminidase__InfluenzaA__ACZ16243

SEQ ID NO: 170156 - RNA, 1410 nt, Artificial Sequence
  derived and/or modified sequence opt4 from neuraminidase__InfluenzaA__ACZ16253
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaacaucgacaaguga

SEQ ID NO: 170157 - RNA, 1410 nt, Artificial Sequence; identical to SEQ ID NO: 169258
  derived and/or modified sequence opt4 from neuraminidase__InfluenzaA__ACZ16263

SEQ ID NO: 170158 - RNA, 1410 nt, Artificial Sequence; identical to SEQ ID NO: 169248
  derived and/or modified sequence opt4 from neuraminidase__InfluenzaA__ACZ16283

SEQ ID NO: 170159 - RNA, 1410 nt, Artificial Sequence; identical to SEQ ID NO: 169258
  derived and/or modified sequence opt4 from neuraminidase__InfluenzaA__ACZ16293

SEQ ID NO: 170160 - RNA, 1410 nt, Artificial Sequence; identical to SEQ ID NO: 169258
  derived and/or modified sequence opt4 from neuraminidase__InfluenzaA__ACZ16303

SEQ ID NO: 170161 - RNA, 1410 nt, Artificial Sequence; identical to SEQ ID NO: 169258
  derived and/or modified sequence opt4 from neuraminidase__InfluenzaA__ACZ16313

SEQ ID NO: 170162 - RNA, 1410 nt, Artificial Sequence; identical to SEQ ID NO: 169258
  derived and/or modified sequence opt4 from neuraminidase__InfluenzaA__ACZ16323

SEQ ID NO: 170163 - RNA, 1410 nt, Artificial Sequence; identical to SEQ ID NO: 169258
  derived and/or modified sequence opt4 from neuraminidase__InfluenzaA__ACZ16333

SEQ ID NO: 170164 - RNA, 1410 nt, Artificial Sequence; identical to SEQ ID NO: 169966
  derived and/or modified sequence opt4 from neuraminidase__InfluenzaA__ACZ16343

SEQ ID NO: 170165 - RNA, 1410 nt, Artificial Sequence; identical to SEQ ID NO: 169258
  derived and/or modified sequence opt4 from neuraminidase__InfluenzaA__ACZ16353

SEQ ID NO: 170166 - RNA, 1410 nt, Artificial Sequence; identical to SEQ ID NO: 169258
  derived and/or modified sequence opt4 from neuraminidase__InfluenzaA__ACZ16363

SEQ ID NO: 170167 - RNA, 1410 nt, Artificial Sequence; identical to SEQ ID NO: 169248
  derived and/or modified sequence opt4 from neuraminidase__InfluenzaA__ACZ16373

SEQ ID NO: 170168 - RNA, 1410 nt, Artificial Sequence; identical to SEQ ID NO: 169258
  derived and/or modified sequence opt4 from neuraminidase__InfluenzaA__ACZ16383

SEQ ID NO: 170169 - RNA, 1410 nt, Artificial Sequence; identical to SEQ ID NO: 169258
  derived and/or modified sequence opt4 from neuraminidase__InfluenzaA__ACZ16393

SEQ ID NO: 170170 - RNA, 1410 nt, Artificial Sequence; identical to SEQ ID NO: 169258
  derived and/or modified sequence opt4 from neuraminidase__InfluenzaA__ACZ16403

SEQ ID NO: 170171 - RNA, 1410 nt, Artificial Sequence; identical to SEQ ID NO: 169258
  derived and/or modified sequence opt4 from neuraminidase__InfluenzaA__ACZ16423

SEQ ID NO: 170172 - RNA, 1410 nt, Artificial Sequence; identical to SEQ ID NO: 169258
  derived and/or modified sequence opt4 from neuraminidase__InfluenzaA__ACZ16433

SEQ ID NO: 170173 - RNA, 1410 nt, Artificial Sequence; identical to SEQ ID NO: 169258
  derived and/or modified sequence opt4 from neuraminidase__InfluenzaA__ACZ16443

SEQ ID NO: 170174 - RNA, 1410 nt, Artificial Sequence; identical to SEQ ID NO: 169258
  derived and/or modified sequence opt4 from neuraminidase__InfluenzaA__ACZ16453

SEQ ID NO: 170175 - RNA, 1410 nt, Artificial Sequence; identical to SEQ ID NO: 169966
  derived and/or modified sequence opt4 from neuraminidase__InfluenzaA__ACZ16463

SEQ ID NO: 170176 - RNA, 1410 nt, Artificial Sequence; identical to SEQ ID NO: 169258
  derived and/or modified sequence opt4 from neuraminidase__InfluenzaA__ACZ16483

SEQ ID NO: 170177 - RNA, 1410 nt, Artificial Sequence; identical to SEQ ID NO: 169258
  derived and/or modified sequence opt4 from neuraminidase__InfluenzaA__ACZ16493

SEQ ID NO: 170178 - RNA, 1410 nt, Artificial Sequence
  derived and/or modified sequence opt4 from neuraminidase__InfluenzaA__ACZ16503
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagauggacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170179 - RNA, 1410 nt, Artificial Sequence; identical to SEQ ID NO: 169966
  derived and/or modified sequence opt4 from neuraminidase__InfluenzaA__ACZ16513

SEQ ID NO: 170180 - RNA, 1410 nt, Artificial Sequence; identical to SEQ ID NO: 169258
  derived and/or modified sequence opt4 from neuraminidase__InfluenzaA__ACZ16523

SEQ ID NO: 170181 - RNA, 1410 nt, Artificial Sequence; identical to SEQ ID NO: 169258
  derived and/or modified sequence opt4 from neuraminidase__InfluenzaA__ACZ16533

SEQ ID NO: 170182 - RNA, 1410 nt, Artificial Sequence; identical to SEQ ID NO: 169248
  derived and/or modified sequence opt4 from neuraminidase__InfluenzaA__ACZ16543

SEQ ID NO: 170183 - RNA, 1410 nt, Artificial Sequence; identical to SEQ ID NO: 169258
  derived and/or modified sequence opt4 from neuraminidase__InfluenzaA__ACZ16553

SEQ ID NO: 170184 - RNA, 1410 nt, Artificial Sequence; identical to SEQ ID NO: 169258
  derived and/or modified sequence opt4 from neuraminidase__InfluenzaA__ACZ16586

SEQ ID NO: 170185 - RNA, 1410 nt, Artificial Sequence; identical to SEQ ID NO: 169258
  derived and/or modified sequence opt4 from neuraminidase__InfluenzaA__ACZ16596

SEQ ID NO: 170186 - RNA, 1410 nt, Artificial Sequence; identical to SEQ ID NO: 169258
  derived and/or modified sequence opt4 from neuraminidase__InfluenzaA__ACZ16606

SEQ ID NO: 170187 - RNA, 1410 nt, Artificial Sequence; identical to SEQ ID NO: 169258
  derived and/or modified sequence opt4 from neuraminidase__InfluenzaA__ACZ16633

SEQ ID NO: 170188 - RNA, 1410 nt, Artificial Sequence
  derived and/or modified sequence opt4 from neuraminidase__InfluenzaA__ACZ16643
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugagauacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170189 - RNA, 1410 nt, Artificial Sequence; identical to SEQ ID NO: 169258
  derived and/or modified sequence opt4 from neuraminidase__InfluenzaA__ACZ16653

SEQ ID NO: 170190 - RNA, 1410 nt, Artificial Sequence; identical to SEQ ID NO: 169258
  derived and/or modified sequence opt4 from neuraminidase__InfluenzaA__ACZ16663

SEQ ID NO: 170191 - RNA, 1410 nt, Artificial Sequence; identical to SEQ ID NO: 169258
  derived and/or modified sequence opt4 from neuraminidase__InfluenzaA__ACZ16673

SEQ ID NO: 170192 - RNA, 1410 nt, Artificial Sequence; identical to SEQ ID NO: 169258
  derived and/or modified sequence opt4 from neuraminidase__InfluenzaA__ACZ16683

SEQ ID NO: 170193 - RNA, 1410 nt, Artificial Sequence; identical to SEQ ID NO: 169258
  derived and/or modified sequence opt4 from neuraminidase__InfluenzaA__ACZ16693

SEQ ID NO: 170194 - RNA, 1410 nt, Artificial Sequence; identical to SEQ ID NO: 169258
  derived and/or modified sequence opt4 from neuraminidase__InfluenzaA__ACZ16703

SEQ ID NO: 170195 - RNA, 1410 nt, Artificial Sequence; identical to SEQ ID NO: 169258
  derived and/or modified sequence opt4 from neuraminidase__InfluenzaA__ACZ16713

SEQ ID NO: 170196 - RNA, 1410 nt, Artificial Sequence; identical to SEQ ID NO: 169258
  derived and/or modified sequence opt4 from neuraminidase__InfluenzaA__ACZ16723

SEQ ID NO: 170197 - RNA, 1410 nt, Artificial Sequence; identical to SEQ ID NO: 169258
  derived and/or modified sequence opt4 from neuraminidase__InfluenzaA__ACZ16733

SEQ ID NO: 170198 - RNA, 1410 nt, Artificial Sequence; identical to SEQ ID NO: 169258
  derived and/or modified sequence opt4 from neuraminidase__InfluenzaA__ACZ16743

SEQ ID NO: 170199 - RNA, 1410 nt, Artificial Sequence; identical to SEQ ID NO: 169258
  derived and/or modified sequence opt4 from neuraminidase__InfluenzaA__ACZ16753

SEQ ID NO: 170200 - RNA, 1410 nt, Artificial Sequence; identical to SEQ ID NO: 169258
  derived and/or modified sequence opt4 from neuraminidase__InfluenzaA__ACZ16763

SEQ ID NO: 170201 - RNA, 1410 nt, Artificial Sequence; identical to SEQ ID NO: 169248
  derived and/or modified sequence opt4 from neuraminidase__InfluenzaA__ACZ16773

SEQ ID NO: 170202 - RNA, 1410 nt, Artificial Sequence; identical to SEQ ID NO: 169258
  derived and/or modified sequence opt4 from neuraminidase__InfluenzaA__ACZ16783

SEQ ID NO: 170203 - RNA, 1410 nt, Artificial Sequence; identical to SEQ ID NO: 169258
  derived and/or modified sequence opt4 from neuraminidase__InfluenzaA__ACZ16793

SEQ ID NO: 170204 - RNA, 1410 nt, Artificial Sequence; identical to SEQ ID NO: 169258
  derived and/or modified sequence opt4 from neuraminidase__InfluenzaA__ACZ16803

SEQ ID NO: 170205 - RNA, 1410 nt, Artificial Sequence; identical to SEQ ID NO: 169258
  derived and/or modified sequence opt4 from neuraminidase__InfluenzaA__ACZ16813

SEQ ID NO: 170206 - RNA, 1410 nt, Artificial Sequence; identical to SEQ ID NO: 169248
  derived and/or modified sequence opt4 from neuraminidase__InfluenzaA__ACZ16823

SEQ ID NO: 170207 - RNA, 1410 nt, Artificial Sequence; identical to SEQ ID NO: 169258
  derived and/or modified sequence opt4 from neuraminidase__InfluenzaA__ACZ16833

SEQ ID NO: 170208 - RNA, 1410 nt, Artificial Sequence; identical to SEQ ID NO: 169258
  derived and/or modified sequence opt4 from neuraminidase__InfluenzaA__ACZ16843

SEQ ID NO: 170209 - RNA, 1410 nt, Artificial Sequence; identical to SEQ ID NO: 170178
  derived and/or modified sequence opt4 from neuraminidase__InfluenzaA__ACZ16853

SEQ ID NO: 170210 - RNA, 1410 nt, Artificial Sequence; identical to SEQ ID NO: 169258
  derived and/or modified sequence opt4 from neuraminidase__InfluenzaA__ACZ16863

SEQ ID NO: 170211 - RNA, 1410 nt, Artificial Sequence; identical to SEQ ID NO: 169258
  derived and/or modified sequence opt4 from neuraminidase__InfluenzaA__ACZ16873

SEQ ID NO: 170212 - RNA, 1410 nt, Artificial Sequence; identical to SEQ ID NO: 169258
  derived and/or modified sequence opt4 from neuraminidase__InfluenzaA__ACZ16883

SEQ ID NO: 170213 - RNA, 1410 nt, Artificial Sequence; identical to SEQ ID NO: 169258
  derived and/or modified sequence opt4 from neuraminidase__InfluenzaA__ACZ16893

SEQ ID NO: 170214 - RNA, 1410 nt, Artificial Sequence; identical to SEQ ID NO: 169258
  derived and/or modified sequence opt4 from neuraminidase__InfluenzaA__ACZ16903

SEQ ID NO: 170215 - RNA, 1410 nt, Artificial Sequence; identical to SEQ ID NO: 169258
  derived and/or modified sequence opt4 from neuraminidase__InfluenzaA__ACZ16913

SEQ ID NO: 170216 - RNA, 1410 nt, Artificial Sequence; identical to SEQ ID NO: 169258
  derived and/or modified sequence opt4 from neuraminidase__InfluenzaA__ACZ16923

SEQ ID NO: 170217 - RNA, 1410 nt, Artificial Sequence; identical to SEQ ID NO: 169258
  derived and/or modified sequence opt4 from neuraminidase__InfluenzaA__ACZ16933

SEQ ID NO: 170218 - RNA, 1410 nt, Artificial Sequence; identical to SEQ ID NO: 169258
  derived and/or modified sequence opt4 from neuraminidase__InfluenzaA__ACZ16943

SEQ ID NO: 170219 - RNA, 1410 nt, Artificial Sequence; identical to SEQ ID NO: 169248
  derived and/or modified sequence opt4 from neuraminidase__InfluenzaA__ACZ16953

SEQ ID NO: 170220 - RNA, 1410 nt, Artificial Sequence; identical to SEQ ID NO: 169258
  derived and/or modified sequence opt4 from neuraminidase__InfluenzaA__ACZ16963

SEQ ID NO: 170221 - RNA, 1410 nt, Artificial Sequence; identical to SEQ ID NO: 169258
  derived and/or modified sequence opt4 from neuraminidase__InfluenzaA__ACZ16973

SEQ ID NO: 170222 - RNA, 1410 nt, Artificial Sequence; identical to SEQ ID NO: 169258
  derived and/or modified sequence opt4 from neuraminidase__InfluenzaA__ACZ16983

SEQ ID NO: 170223 - RNA, 1410 nt, Artificial Sequence; identical to SEQ ID NO: 169258
  derived and/or modified sequence opt4 from neuraminidase__InfluenzaA__ACZ16993

SEQ ID NO: 170224 - RNA, 1410 nt, Artificial Sequence; identical to SEQ ID NO: 169258
  derived and/or modified sequence opt4 from neuraminidase__InfluenzaA__ACZ17003

SEQ ID NO: 170225 - RNA, 1410 nt, Artificial Sequence; identical to SEQ ID NO: 169258
  derived and/or modified sequence opt4 from neuraminidase__InfluenzaA__ACZ17023

SEQ ID NO: 170226 - RNA, 1410 nt, Artificial Sequence; identical to SEQ ID NO: 169258
  derived and/or modified sequence opt4 from neuraminidase__InfluenzaA__ACZ17043

SEQ ID NO: 170227 - RNA, 1410 nt, Artificial Sequence; identical to SEQ ID NO: 169258
  derived and/or modified sequence opt4 from neuraminidase__InfluenzaA__ACZ17053

SEQ ID NO: 170228 - RNA, 1410 nt, Artificial Sequence
  derived and/or modified sequence opt4 from neuraminidase__InfluenzaA__ACZ17063
augaaccccaaccagaagaucaucaccaucggcagcgugugcaugaccaucggcauggccaaccugauccugcagaucggcaacaucaucagcaucuggaucagccacagcauccagcugggcgaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170229 - RNA, 1410 nt, Artificial Sequence; identical to SEQ ID NO: 169258
  derived and/or modified sequence opt4 from neuraminidase__InfluenzaA__ACZ17073

SEQ ID NO: 170230 - RNA, 1410 nt, Artificial Sequence; identical to SEQ ID NO: 169966
  derived and/or modified sequence opt4 from neuraminidase__InfluenzaA__ACZ17083

SEQ ID NO: 170231 - RNA, 1410 nt, Artificial Sequence
  derived and/or modified sequence opt4 from neuraminidase__InfluenzaA__ACZ17093
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccccuucgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170232 - RNA, 1410 nt, Artificial Sequence
  derived and/or modified sequence opt4 from neuraminidase__InfluenzaA__ACZ17113
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170233 - RNA, 1410 nt, Artificial Sequence; identical to SEQ ID NO: 169258
  derived and/or modified sequence opt4 from neuraminidase__InfluenzaA__ACZ17123

SEQ ID NO: 170234 - RNA, 1410 nt, Artificial Sequence; identical to SEQ ID NO: 169258
  derived and/or modified sequence opt4 from neuraminidase__InfluenzaA__ACZ17133

SEQ ID NO: 170235 - RNA, 1410 nt, Artificial Sequence
  derived and/or modified sequence opt4 from neuraminidase__InfluenzaA__ACZ17163
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaacagaaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170236 - RNA, 1410 nt, Artificial Sequence; identical to SEQ ID NO: 170235
  derived and/or modified sequence opt4 from neuraminidase__InfluenzaA__ACZ17173

SEQ ID NO: 170237 - RNA, 1410 nt, Artificial Sequence; identical to SEQ ID NO: 170235
  derived and/or modified sequence opt4 from neuraminidase__InfluenzaA__ACZ17183

SEQ ID NO: 170238 - RNA, 1410 nt, Artificial Sequence; identical to SEQ ID NO: 170235
  derived and/or modified sequence opt4 from neuraminidase__InfluenzaA__ACZ17193

SEQ ID NO: 170239 - RNA, 1410 nt, Artificial Sequence; identical to SEQ ID NO: 170235
  derived and/or modified sequence opt4 from neuraminidase__InfluenzaA__ACZ17203

SEQ ID NO: 170240 - RNA, 1410 nt, Artificial Sequence; identical to SEQ ID NO: 169258
  derived and/or modified sequence opt4 from neuraminidase__InfluenzaA__ACZ17213

SEQ ID NO: 170241 - RNA, 1410 nt, Artificial Sequence; identical to SEQ ID NO: 169258
  derived and/or modified sequence opt4 from neuraminidase__InfluenzaA__ACZ17223

SEQ ID NO: 170242 - RNA, 1410 nt, Artificial Sequence; identical to SEQ ID NO: 169258
  derived and/or modified sequence opt4 from neuraminidase__InfluenzaA__ACZ17233

SEQ ID NO: 170243 - RNA, 1410 nt, Artificial Sequence; identical to SEQ ID NO: 169258
  derived and/or modified sequence opt4 from neuraminidase__InfluenzaA__ACZ17243

SEQ ID NO: 170244 - RNA, 1410 nt, Artificial Sequence; identical to SEQ ID NO: 169258
  derived and/or modified sequence opt4 from neuraminidase__InfluenzaA__ACZ17263

SEQ ID NO: 170245 - RNA, 1410 nt, Artificial Sequence
  derived and/or modified sequence opt4 from neuraminidase__InfluenzaA__ACZ17273
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcuucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugcugagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170246 - RNA, 1410 nt, Artificial Sequence; identical to SEQ ID NO: 169258
  derived and/or modified sequence opt4 from neuraminidase__InfluenzaA__ACZ17283

SEQ ID NO: 170247 - RNA, 1410 nt, Artificial Sequence; identical to SEQ ID NO: 169288
  derived and/or modified sequence opt4 from neuraminidase__InfluenzaA__ACZ17293

SEQ ID NO: 170248 - RNA, 1410 nt, Artificial Sequence; identical to SEQ ID NO: 169288
  derived and/or modified sequence opt4 from neuraminidase__InfluenzaA__ACZ17303

SEQ ID NO: 170249 - RNA, 1410 nt, Artificial Sequence; identical to SEQ ID NO: 169288
  derived and/or modified sequence opt4 from neuraminidase__InfluenzaA__ACZ17313

SEQ ID NO: 170250 - RNA, 1410 nt, Artificial Sequence; identical to SEQ ID NO: 169258
  derived and/or modified sequence opt4 from neuraminidase__InfluenzaA__ACZ17401

SEQ ID NO: 170251 - RNA, 1410 nt, Artificial Sequence; identical to SEQ ID NO: 169258
  derived and/or modified sequence opt4 from neuraminidase__InfluenzaA__ACZ17411

SEQ ID NO: 170252 - RNA, 1410 nt, Artificial Sequence; identical to SEQ ID NO: 169258
  derived and/or modified sequence opt4 from neuraminidase__InfluenzaA__ACZ17421

SEQ ID NO: 170253 - RNA, 1410 nt, Artificial Sequence
  derived and/or modified sequence opt4 from neuraminidase__InfluenzaA__ACZ17431
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaacagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170254 - RNA, 1410 nt, Artificial Sequence; identical to SEQ ID NO: 170253
  derived and/or modified sequence opt4 from neuraminidase__InfluenzaA__ACZ17441

SEQ ID NO: 170255 - RNA, 1410 nt, Artificial Sequence; identical to SEQ ID NO: 169248
  derived and/or modified sequence opt4 from neuraminidase__InfluenzaA__ACZ17451

SEQ ID NO: 170256 - RNA, 1410 nt, Artificial Sequence; identical to SEQ ID NO: 169258
  derived and/or modified sequence opt4 from neuraminidase__InfluenzaA__ACZ17461

SEQ ID NO: 170257 - RNA, 1410 nt, Artificial Sequence; identical to SEQ ID NO: 169258
  derived and/or modified sequence opt4 from neuraminidase__InfluenzaA__ACZ17471

SEQ ID NO: 170258 - RNA, 1410 nt, Artificial Sequence; identical to SEQ ID NO: 169288
  derived and/or modified sequence opt4 from neuraminidase__InfluenzaA__ACZ17481

SEQ ID NO: 170259 - RNA, 1410 nt, Artificial Sequence; identical to SEQ ID NO: 169258
  derived and/or modified sequence opt4 from neuraminidase__InfluenzaA__ACZ17491

SEQ ID NO: 170260 - RNA, 1410 nt, Artificial Sequence; identical to SEQ ID NO: 169724
  derived and/or modified sequence opt4 from neuraminidase__InfluenzaA__ACZ27803

SEQ ID NO: 170261 - RNA, 1410 nt, Artificial Sequence; identical to SEQ ID NO: 169248
  derived and/or modified sequence opt4 from neuraminidase__InfluenzaA__ACZ27813

SEQ ID NO: 170262 - RNA, 1410 nt, Artificial Sequence; identical to SEQ ID NO: 169258
  derived and/or modified sequence opt4 from neuraminidase__InfluenzaA__ACZ27823

SEQ ID NO: 170263 - RNA, 1410 nt, Artificial Sequence; identical to SEQ ID NO: 169248
  derived and/or modified sequence opt4 from neuraminidase__InfluenzaA__ACZ27833

SEQ ID NO: 170264 - RNA, 1410 nt, Artificial Sequence; identical to SEQ ID NO: 169258
  derived and/or modified sequence opt4 from neuraminidase__InfluenzaA__ACZ45022

SEQ ID NO: 170265 - RNA, 1410 nt, Artificial Sequence
  derived and/or modified sequence opt4 from neuraminidase__InfluenzaA__ACZ53958
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcugccccgacggcagcgugcugaaccugaugcccaucuga

SEQ ID NO: 170266 - RNA, 1410 nt, Artificial Sequence
  derived and/or modified sequence opt4 from neuraminidase__InfluenzaA__ACZ53969
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcgagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcagcgugcugaaccugaugcccaucuga

SEQ ID NO: 170267 - RNA, 1410 nt, Artificial Sequence
  derived and/or modified sequence opt4 from neuraminidase__InfluenzaA__ACZ53980
augaaccccaaccagaacaagcugcccaucggcagcgugagccugaccaucgccaccaucugcuuccugaugcagaucgccauccugaagaccaccgugacccugcacuucaagcaguacgagugcaacagcccccccaacaaccaggugaugcugugcgagcccaccaucaucgagagaaaccugaccaagaucguguaccugaccaacaccaccaucaagaaggagaucugccccaagcagcccaaguacagaaacuggagcaagcccaagugcaagaucaccgagcuggcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcagcgugcugaaccugaugcccaucuga

SEQ ID NO: 170268 - RNA, 1410 nt, Artificial Sequence; identical to SEQ ID NO: 169258
  derived and/or modified sequence opt4 from neuraminidase__InfluenzaA__ACZ56082

SEQ ID NO: 170269 - RNA, 1410 nt, Artificial Sequence; identical to SEQ ID NO: 169841
  derived and/or modified sequence opt4 from neuraminidase__InfluenzaA__ACZ57183

SEQ ID NO: 170270 - RNA, 1413 nt, Artificial Sequence
  derived and/or modified sequence opt4 from neuraminidase__InfluenzaA__ACZ81542
augaaccccaaccagaaggugaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170271 - RNA, 1413 nt, Artificial Sequence
  derived and/or modified sequence opt4 from neuraminidase__InfluenzaA__ACZ81543
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacaacaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaaggagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaccggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170272 - RNA, 1410 nt, Artificial Sequence
  derived and/or modified sequence opt4 from neuraminidase__InfluenzaA__ACZ81546
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcagcgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 170273 - RNA, 1410 nt, Artificial Sequence
  derived and/or modified sequence opt4 from neuraminidase__InfluenzaA__ACZ81547
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaccaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 170274 - RNA, 1410 nt, Artificial Sequence; identical to SEQ ID NO: 169258
  derived and/or modified sequence opt4 from neuraminidase__InfluenzaA__ACZ81634

SEQ ID NO: 170275 - RNA, 1410 nt, Artificial Sequence
  derived and/or modified sequence opt4 from neuraminidase__InfluenzaA__ACZ81644
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170276 - RNA, 1410 nt, Artificial Sequence
  derived and/or modified sequence opt4 from neuraminidase__InfluenzaA__ACZ81653
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccugaacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170277 - RNA, 1410 nt, Artificial Sequence; identical to SEQ ID NO: 169258
  derived and/or modified sequence opt4 from neuraminidase__InfluenzaA__ACZ95840

SEQ ID NO: 170278 - RNA, 1410 nt, Artificial Sequence; identical to SEQ ID NO: 169258
  derived and/or modified sequence opt4 from neuraminidase__InfluenzaA__ACZ95850

SEQ ID NO: 170279 - RNA, 1410 nt, Artificial Sequence; identical to SEQ ID NO: 169258
  derived and/or modified sequence opt4 from neuraminidase__InfluenzaA__ACZ95860

SEQ ID NO: 170280 - RNA, 1410 nt, Artificial Sequence; identical to SEQ ID NO: 169258
  derived and/or modified sequence opt4 from neuraminidase__InfluenzaA__ACZ95870

SEQ ID NO: 170281 - RNA, 1410 nt, Artificial Sequence; identical to SEQ ID NO: 169258
  derived and/or modified sequence opt4 from neuraminidase__InfluenzaA__ACZ95880

SEQ ID NO: 170282 - RNA, 1410 nt, Artificial Sequence; identical to SEQ ID NO: 169258
  derived and/or modified sequence opt4 from neuraminidase__InfluenzaA__ACZ95890

SEQ ID NO: 170283 - RNA, 1410 nt, Artificial Sequence; identical to SEQ ID NO: 169258
  derived and/or modified sequence opt4 from neuraminidase__InfluenzaA__ACZ95900

SEQ ID NO: 170284 - RNA, 1410 nt, Artificial Sequence; identical to SEQ ID NO: 169258
  derived and/or modified sequence opt4 from neuraminidase__InfluenzaA__ACZ95910

SEQ ID NO: 170285 - RNA, 1410 nt, Artificial Sequence; identical to SEQ ID NO: 169258
  derived and/or modified sequence opt4 from neuraminidase__InfluenzaA__ACZ95920

SEQ ID NO: 170286 - RNA, 1410 nt, Artificial Sequence; identical to SEQ ID NO: 170145
  derived and/or modified sequence opt4 from neuraminidase__InfluenzaA__ACZ95930

SEQ ID NO: 170287 - RNA, 1410 nt, Artificial Sequence; identical to SEQ ID NO: 169258
  derived and/or modified sequence opt4 from neuraminidase__InfluenzaA__ACZ95940

SEQ ID NO: 170288 - RNA, 1410 nt, Artificial Sequence; identical to SEQ ID NO: 170275
  derived and/or modified sequence opt4 from neuraminidase__InfluenzaA__ACZ95950

SEQ ID NO: 170289 - RNA, 1410 nt, Artificial Sequence; identical to SEQ ID NO: 169258
  derived and/or modified sequence opt4 from neuraminidase__InfluenzaA__ACZ95960

SEQ ID NO: 170290 - RNA, 1410 nt, Artificial Sequence; identical to SEQ ID NO: 170275
  derived and/or modified sequence opt4 from neuraminidase__InfluenzaA__ACZ95970

SEQ ID NO: 170291 - RNA, 1410 nt, Artificial Sequence; identical to SEQ ID NO: 169258
  derived and/or modified sequence opt4 from neuraminidase__InfluenzaA__ACZ95980

SEQ ID NO: 170292 - RNA, 1410 nt, Artificial Sequence; identical to SEQ ID NO: 169258
  derived and/or modified sequence opt4 from neuraminidase__InfluenzaA__ACZ95990

SEQ ID NO: 170293 - RNA, 1410 nt, Artificial Sequence; identical to SEQ ID NO: 169258
  derived and/or modified sequence opt4 from neuraminidase__InfluenzaA__ACZ96000

SEQ ID NO: 170294 - RNA, 1410 nt, Artificial Sequence; identical to SEQ ID NO: 169258
  derived and/or modified sequence opt4 from neuraminidase__InfluenzaA__ACZ96010

SEQ ID NO: 170295 - RNA, 1410 nt, Artificial Sequence
  derived and/or modified sequence opt4 from neuraminidase__InfluenzaA__ACZ96020
augaaccccaaccagaagaucaucaccaucggcagcgugugcaugaccaucggcauggccaaccugauccugcagaucggcaacaucauccugaucuggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaucgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170296 - RNA, 1410 nt, Artificial Sequence; identical to SEQ ID NO: 169258
  derived and/or modified sequence opt4 from neuraminidase__InfluenzaA__ACZ96050

SEQ ID NO: 170297 - RNA, 1410 nt, Artificial Sequence; identical to SEQ ID NO: 169258
  derived and/or modified sequence opt4 from neuraminidase__InfluenzaA__ACZ96060

SEQ ID NO: 170298 - RNA, 1410 nt, Artificial Sequence; identical to SEQ ID NO: 169258
  derived and/or modified sequence opt4 from neuraminidase__InfluenzaA__ACZ96072

SEQ ID NO: 170299 - RNA, 1410 nt, Artificial Sequence; identical to SEQ ID NO: 169258
  derived and/or modified sequence opt4 from neuraminidase__InfluenzaA__ACZ96082

SEQ ID NO: 170300 - RNA, 1410 nt, Artificial Sequence; identical to SEQ ID NO: 169258
  derived and/or modified sequence opt4 from neuraminidase__InfluenzaA__ACZ96092

SEQ ID NO: 170301 - RNA, 1410 nt, Artificial Sequence; identical to SEQ ID NO: 169258
  derived and/or modified sequence opt4 from neuraminidase__InfluenzaA__ACZ96102

SEQ ID NO: 170302 - RNA, 1410 nt, Artificial Sequence; identical to SEQ ID NO: 169258
  derived and/or modified sequence opt4 from neuraminidase__InfluenzaA__ACZ96112

SEQ ID NO: 170303 - RNA, 1410 nt, Artificial Sequence
  derived and/or modified sequence opt4 from neuraminidase__InfluenzaA__ACZ96122
augaaccccaaccagaagaucaucaccaucggcagcgugugcaugaccaucggcauggccaaccugauccugcagaucggcaacaucaucagcaucuggaucagccacagcauccagcugggcaaccagaaccagaucgaggccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaaggacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcaucaacagcgacaccgugggcuggagcuggcccgacggcgccgagcugcccuucaccaucgacaaguga

SEQ ID NO: 170304 - RNA, 1410 nt, Artificial Sequence; identical to SEQ ID NO: 169258
  derived and/or modified sequence opt4 from neuraminidase__InfluenzaA__ACZ96132

SEQ ID NO: 170305 - RNA, 1410 nt, Artificial Sequence; identical to SEQ ID NO: 169258
  derived and/or modified sequence opt4 from neuraminidase__InfluenzaA__ACZ96142

SEQ ID NO: 170306 - RNA, 1410 nt, Artificial Sequence; identical to SEQ ID NO: 169258
  derived and/or modified sequence opt4 from neuraminidase__InfluenzaA__ACZ96152

SEQ ID NO: 170307 - RNA, 1410 nt, Artificial Sequence; identical to SEQ ID NO: 169258
  derived and/or modified sequence opt4 from neuraminidase__InfluenzaA__ACZ96162

SEQ ID NO: 170308 - RNA, 1410 nt, Artificial Sequence; identical to SEQ ID NO: 169258
  derived and/or modified sequence opt4 from neuraminidase__InfluenzaA__ACZ96172

SEQ ID NO: 170309 - RNA, 1410 nt, Artificial Sequence
  derived and/or modified sequence opt4 from neuraminidase__InfluenzaA__ACZ96182
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacagacacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170310 - RNA, 1410 nt, Artificial Sequence
  derived and/or modified sequence opt4 from neuraminidase__InfluenzaA__ACZ96192
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaagcaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170311 - RNA, 1410 nt, Artificial Sequence
  derived and/or modified sequence opt4 from neuraminidase__InfluenzaA__ACZ96232
augaaccccaaccagaagaucaucaccaucggcagcgugugcaugaccgugggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacgacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170312 - RNA, 1410 nt, Artificial Sequence
  derived and/or modified sequence opt4 from neuraminidase__InfluenzaA__ACZ96242
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 170313 - RNA, 1410 nt, Artificial Sequence; identical to SEQ ID NO: 169258
  derived and/or modified sequence opt4 from neuraminidase__InfluenzaA__ACZ96252

SEQ ID NO: 170314 - RNA, 1410 nt, Artificial Sequence; identical to SEQ ID NO: 169258
  derived and/or modified sequence opt4 from neuraminidase__InfluenzaA__ACZ96292

SEQ ID NO: 170315 - RNA, 1410 nt, Artificial Sequence; identical to SEQ ID NO: 169258
  derived and/or modified sequence opt4 from neuraminidase__InfluenzaA__ACZ96302

SEQ ID NO: 170316 - RNA, 1410 nt, Artificial Sequence; identical to SEQ ID NO: 169258
  derived and/or modified sequence opt4 from neuraminidase__InfluenzaA__ACZ96312

SEQ ID NO: 170317 - RNA, 1410 nt, Artificial Sequence
  derived and/or modified sequence opt4 from neuraminidase__InfluenzaA__ACZ96322
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcugaccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170318 - RNA, 1410 nt, Artificial Sequence; identical to SEQ ID NO: 170317
  derived and/or modified sequence opt4 from neuraminidase__InfluenzaA__ACZ96332

SEQ ID NO: 170319 - RNA, 1410 nt, Artificial Sequence; identical to SEQ ID NO: 169258
  derived and/or modified sequence opt4 from neuraminidase__InfluenzaA__ACZ96352

SEQ ID NO: 170320 - RNA, 1410 nt, Artificial Sequence; identical to SEQ ID NO: 170317
  derived and/or modified sequence opt4 from neuraminidase__InfluenzaA__ACZ96362

SEQ ID NO: 170321 - RNA, 1410 nt, Artificial Sequence; identical to SEQ ID NO: 169258
  derived and/or modified sequence opt4 from neuraminidase__InfluenzaA__ACZ96375

SEQ ID NO: 170322 - RNA, 1410 nt, Artificial Sequence; identical to SEQ ID NO: 170317
  derived and/or modified sequence opt4 from neuraminidase__InfluenzaA__ACZ96385

SEQ ID NO: 170323 - RNA, 1410 nt, Artificial Sequence
  derived and/or modified sequence opt4 from neuraminidase__InfluenzaA__ACZ96395
augaaccccaaccagaagaucaucaccaucggcagcgugugcaugaccaucggcauggccaaccugauccugcagaucggcaacaucaucagcaucuggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaucgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170324 - RNA, 1410 nt, Artificial Sequence; identical to SEQ ID NO: 169258
  derived and/or modified sequence opt4 from neuraminidase__InfluenzaA__ACZ96408

SEQ ID NO: 170325 - RNA, 1410 nt, Artificial Sequence; identical to SEQ ID NO: 169258
  derived and/or modified sequence opt4 from neuraminidase__InfluenzaA__ACZ96428

SEQ ID NO: 170326 - RNA, 1410 nt, Artificial Sequence; identical to SEQ ID NO: 169258
  derived and/or modified sequence opt4 from neuraminidase__InfluenzaA__ACZ96438

SEQ ID NO: 170327 - RNA, 1410 nt, Artificial Sequence; identical to SEQ ID NO: 169258
  derived and/or modified sequence opt4 from neuraminidase__InfluenzaA__ACZ96448

SEQ ID NO: 170328 - RNA, 1410 nt, Artificial Sequence; identical to SEQ ID NO: 169258
  derived and/or modified sequence opt4 from neuraminidase__InfluenzaA__ACZ96479

SEQ ID NO: 170329 - RNA, 1410 nt, Artificial Sequence; identical to SEQ ID NO: 170275
  derived and/or modified sequence opt4 from neuraminidase__InfluenzaA__ACZ96489

SEQ ID NO: 170330 - RNA, 1410 nt, Artificial Sequence; identical to SEQ ID NO: 169258
  derived and/or modified sequence opt4 from neuraminidase__InfluenzaA__ACZ96499

SEQ ID NO: 170331 - RNA, 1410 nt, Artificial Sequence
  derived and/or modified sequence opt4 from neuraminidase__InfluenzaA__ACZ96509
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccuggaucaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170332 - RNA, 1410 nt, Artificial Sequence; identical to SEQ ID NO: 169258
  derived and/or modified sequence opt4 from neuraminidase__InfluenzaA__ACZ96519

SEQ ID NO: 170333 - RNA, 1410 nt, Artificial Sequence; identical to SEQ ID NO: 169258
  derived and/or modified sequence opt4 from neuraminidase__InfluenzaA__ACZ96529

SEQ ID NO: 170334 - RNA, 1410 nt, Artificial Sequence
  derived and/or modified sequence opt4 from neuraminidase__InfluenzaA__ACZ96552
augaaccccaaccagaagaucaucaccaucggcagcgugugcaugaccaucggcauggccaaccugauccugcagaucggcaacaucaucagcaucuggaucagccacagcagccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170335 - RNA, 1410 nt, Artificial Sequence; identical to SEQ ID NO: 169258
  derived and/or modified sequence opt4 from neuraminidase__InfluenzaA__ACZ96562

SEQ ID NO: 170336 - RNA, 1410 nt, Artificial Sequence; identical to SEQ ID NO: 169258
  derived and/or modified sequence opt4 from neuraminidase__InfluenzaA__ACZ96572

SEQ ID NO: 170337 - RNA, 1410 nt, Artificial Sequence; identical to SEQ ID NO: 169258
  derived and/or modified sequence opt4 from neuraminidase__InfluenzaA__ACZ96582

SEQ ID NO: 170338 - RNA, 1410 nt, Artificial Sequence
  derived and/or modified sequence opt4 from neuraminidase__InfluenzaA__ACZ96592
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccagagcagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170339 - RNA, 1410 nt, Artificial Sequence; identical to SEQ ID NO: 169258
  derived and/or modified sequence opt4 from neuraminidase__InfluenzaA__ACZ96602

SEQ ID NO: 170340 - RNA, 1410 nt, Artificial Sequence
  derived and/or modified sequence opt4 from neuraminidase__InfluenzaA__ACZ96612
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcguggugaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170341 - RNA, 1410 nt, Artificial Sequence; identical to SEQ ID NO: 169288
  derived and/or modified sequence opt4 from neuraminidase__InfluenzaA__ACZ96622

SEQ ID NO: 170342 - RNA, 1410 nt, Artificial Sequence; identical to SEQ ID NO: 169288
  derived and/or modified sequence opt4 from neuraminidase__InfluenzaA__ACZ96632

SEQ ID NO: 170343 - RNA, 1410 nt, Artificial Sequence; identical to SEQ ID NO: 169288
  derived and/or modified sequence opt4 from neuraminidase__InfluenzaA__ACZ96642

SEQ ID NO: 170344 - RNA, 1410 nt, Artificial Sequence; identical to SEQ ID NO: 169288
  derived and/or modified sequence opt4 from neuraminidase__InfluenzaA__ACZ96652

SEQ ID NO: 170345 - RNA, 1410 nt, Artificial Sequence; identical to SEQ ID NO: 169288
  derived and/or modified sequence opt4 from neuraminidase__InfluenzaA__ACZ96662

SEQ ID NO: 170346 - RNA, 1410 nt, Artificial Sequence; identical to SEQ ID NO: 169288
  derived and/or modified sequence opt4 from neuraminidase__InfluenzaA__ACZ96672

SEQ ID NO: 170347 - RNA, 1410 nt, Artificial Sequence; identical to SEQ ID NO: 169288
  derived and/or modified sequence opt4 from neuraminidase__InfluenzaA__ACZ96682

SEQ ID NO: 170348 - RNA, 1410 nt, Artificial Sequence; identical to SEQ ID NO: 169288
  derived and/or modified sequence opt4 from neuraminidase__InfluenzaA__ACZ96692

SEQ ID NO: 170349 - RNA, 1410 nt, Artificial Sequence; identical to SEQ ID NO: 169288
  derived and/or modified sequence opt4 from neuraminidase__InfluenzaA__ACZ96702

SEQ ID NO: 170350 - RNA, 1410 nt, Artificial Sequence; identical to SEQ ID NO: 169288
  derived and/or modified sequence opt4 from neuraminidase__InfluenzaA__ACZ96712

SEQ ID NO: 170351 - RNA, 1410 nt, Artificial Sequence; identical to SEQ ID NO: 169288
  derived and/or modified sequence opt4 from neuraminidase__InfluenzaA__ACZ96722

SEQ ID NO: 170352 - RNA, 1410 nt, Artificial Sequence; identical to SEQ ID NO: 169288
  derived and/or modified sequence opt4 from neuraminidase__InfluenzaA__ACZ96732

SEQ ID NO: 170353 - RNA, 1410 nt, Artificial Sequence; identical to SEQ ID NO: 169288
  derived and/or modified sequence opt4 from neuraminidase__InfluenzaA__ACZ96742

SEQ ID NO: 170354 - RNA, 1410 nt, Artificial Sequence; identical to SEQ ID NO: 169248
  derived and/or modified sequence opt4 from neuraminidase__InfluenzaA__ACZ96752

SEQ ID NO: 170355 - RNA, 1410 nt, Artificial Sequence; identical to SEQ ID NO: 169248
  derived and/or modified sequence opt4 from neuraminidase__InfluenzaA__ACZ96762

SEQ ID NO: 170356 - RNA, 1410 nt, Artificial Sequence; identical to SEQ ID NO: 169248
  derived and/or modified sequence opt4 from neuraminidase__InfluenzaA__ACZ96772

SEQ ID NO: 170357 - RNA, 1410 nt, Artificial Sequence; identical to SEQ ID NO: 169248
  derived and/or modified sequence opt4 from neuraminidase__InfluenzaA__ACZ96782

SEQ ID NO: 170358 - RNA, 1410 nt, Artificial Sequence; identical to SEQ ID NO: 169248
  derived and/or modified sequence opt4 from neuraminidase__InfluenzaA__ACZ96792

SEQ ID NO: 170359 - RNA, 1410 nt, Artificial Sequence; identical to SEQ ID NO: 169258
  derived and/or modified sequence opt4 from neuraminidase__InfluenzaA__ACZ96802

SEQ ID NO: 170360 - RNA, 1410 nt, Artificial Sequence; identical to SEQ ID NO: 169258
  derived and/or modified sequence opt4 from neuraminidase__InfluenzaA__ACZ96812

SEQ ID NO: 170361 - RNA, 1410 nt, Artificial Sequence; identical to SEQ ID NO: 169841
  derived and/or modified sequence opt4 from neuraminidase__InfluenzaA__ACZ96822

SEQ ID NO: 170362 - RNA, 1410 nt, Artificial Sequence
  derived and/or modified sequence opt4 from neuraminidase__InfluenzaA__ACZ96842
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaucgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170363 - RNA, 1410 nt, Artificial Sequence; identical to SEQ ID NO: 169258
  derived and/or modified sequence opt4 from neuraminidase__InfluenzaA__ACZ96852

SEQ ID NO: 170364 - RNA, 1410 nt, Artificial Sequence; identical to SEQ ID NO: 169258
  derived and/or modified sequence opt4 from neuraminidase__InfluenzaA__ACZ96862

SEQ ID NO: 170365 - RNA, 1410 nt, Artificial Sequence
  derived and/or modified sequence opt4 from neuraminidase__InfluenzaA__ACZ96872
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcaugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170366 - RNA, 1410 nt, Artificial Sequence; identical to SEQ ID NO: 169248
  derived and/or modified sequence opt4 from neuraminidase__InfluenzaA__ACZ96882

SEQ ID NO: 170367 - RNA, 1410 nt, Artificial Sequence; identical to SEQ ID NO: 170365
  derived and/or modified sequence opt4 from neuraminidase__InfluenzaA__ACZ96892

SEQ ID NO: 170368 - RNA, 1410 nt, Artificial Sequence; identical to SEQ ID NO: 170365
  derived and/or modified sequence opt4 from neuraminidase__InfluenzaA__ACZ96902

SEQ ID NO: 170369 - RNA, 1410 nt, Artificial Sequence; identical to SEQ ID NO: 169248
  derived and/or modified sequence opt4 from neuraminidase__InfluenzaA__ACZ96912

SEQ ID NO: 170370 - RNA, 1410 nt, Artificial Sequence; identical to SEQ ID NO: 169248
  derived and/or modified sequence opt4 from neuraminidase__InfluenzaA__ACZ96922

SEQ ID NO: 170371 - RNA, 1410 nt, Artificial Sequence; identical to SEQ ID NO: 170365
  derived and/or modified sequence opt4 from neuraminidase__InfluenzaA__ACZ96932

SEQ ID NO: 170372 - RNA, 1410 nt, Artificial Sequence; identical to SEQ ID NO: 170365
  derived and/or modified sequence opt4 from neuraminidase__InfluenzaA__ACZ96942

SEQ ID NO: 170373 - RNA, 1410 nt, Artificial Sequence; identical to SEQ ID NO: 169248
  derived and/or modified sequence opt4 from neuraminidase__InfluenzaA__ACZ96952

SEQ ID NO: 170374 - RNA, 1410 nt, Artificial Sequence; identical to SEQ ID NO: 169248
  derived and/or modified sequence opt4 from neuraminidase__InfluenzaA__ACZ97024

SEQ ID NO: 170375 - RNA, 1410 nt, Artificial Sequence; identical to SEQ ID NO: 170365
  derived and/or modified sequence opt4 from neuraminidase__InfluenzaA__ACZ97336

SEQ ID NO: 170376 - RNA, 1410 nt, Artificial Sequence; identical to SEQ ID NO: 170365
  derived and/or modified sequence opt4 from neuraminidase__InfluenzaA__ACZ97346

SEQ ID NO: 170377 - RNA, 1410 nt, Artificial Sequence; identical to SEQ ID NO: 169258
  derived and/or modified sequence opt4 from neuraminidase__InfluenzaA__ACZ97366

SEQ ID NO: 170378 - RNA, 1410 nt, Artificial Sequence; identical to SEQ ID NO: 169258
  derived and/or modified sequence opt4 from neuraminidase__InfluenzaA__ACZ97376

SEQ ID NO: 170379 - RNA, 1410 nt, Artificial Sequence; identical to SEQ ID NO: 169258
  derived and/or modified sequence opt4 from neuraminidase__InfluenzaA__ACZ97386

SEQ ID NO: 170380 - RNA, 1410 nt, Artificial Sequence; identical to SEQ ID NO: 170365
  derived and/or modified sequence opt4 from neuraminidase__InfluenzaA__ACZ97396

SEQ ID NO: 170381 - RNA, 1410 nt, Artificial Sequence; identical to SEQ ID NO: 169258
  derived and/or modified sequence opt4 from neuraminidase__InfluenzaA__ACZ98171

SEQ ID NO: 170382 - RNA, 1410 nt, Artificial Sequence; identical to SEQ ID NO: 169258
  derived and/or modified sequence opt4 from neuraminidase__InfluenzaA__ACZ98181

SEQ ID NO: 170383 - RNA, 1410 nt, Artificial Sequence
  derived and/or modified sequence opt4 from neuraminidase__InfluenzaA__ACZ98191
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucagcuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170384 - RNA, 1410 nt, Artificial Sequence; identical to SEQ ID NO: 169248
  derived and/or modified sequence opt4 from neuraminidase__InfluenzaA__ACZ98201

SEQ ID NO: 170385 - RNA, 1410 nt, Artificial Sequence; identical to SEQ ID NO: 169258
  derived and/or modified sequence opt4 from neuraminidase__InfluenzaA__ACZ98211

SEQ ID NO: 170386 - RNA, 1410 nt, Artificial Sequence; identical to SEQ ID NO: 169258
  derived and/or modified sequence opt4 from neuraminidase__InfluenzaA__ACZ98221

SEQ ID NO: 170387 - RNA, 1410 nt, Artificial Sequence; identical to SEQ ID NO: 169258
  derived and/or modified sequence opt4 from neuraminidase__InfluenzaA__ACZ98231

SEQ ID NO: 170388 - RNA, 1410 nt, Artificial Sequence; identical to SEQ ID NO: 169258
  derived and/or modified sequence opt4 from neuraminidase__InfluenzaA__ACZ98241

SEQ ID NO: 170389 - RNA, 1410 nt, Artificial Sequence; identical to SEQ ID NO: 170235
  derived and/or modified sequence opt4 from neuraminidase__InfluenzaA__ACZ98251

SEQ ID NO: 170390 - RNA, 1410 nt, Artificial Sequence; identical to SEQ ID NO: 169258
  derived and/or modified sequence opt4 from neuraminidase__InfluenzaA__ACZ98261

SEQ ID NO: 170391 - RNA, 1410 nt, Artificial Sequence; identical to SEQ ID NO: 169258
  derived and/or modified sequence opt4 from neuraminidase__InfluenzaA__ACZ98271

SEQ ID NO: 170392 - RNA, 1410 nt, Artificial Sequence; identical to SEQ ID NO: 169258
  derived and/or modified sequence opt4 from neuraminidase__InfluenzaA__ACZ98281

SEQ ID NO: 170393 - RNA, 1410 nt, Artificial Sequence; identical to SEQ ID NO: 169258
  derived and/or modified sequence opt4 from neuraminidase__InfluenzaA__ACZ98291

SEQ ID NO: 170394 - RNA, 1410 nt, Artificial Sequence; identical to SEQ ID NO: 169248
  derived and/or modified sequence opt4 from neuraminidase__InfluenzaA__ACZ98301

SEQ ID NO: 170395 - RNA, 1410 nt, Artificial Sequence
  derived and/or modified sequence opt4 from neuraminidase__InfluenzaA__ACZ98321
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaacagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170396 - RNA, 1410 nt, Artificial Sequence; identical to SEQ ID NO: 169258
  derived and/or modified sequence opt4 from neuraminidase__InfluenzaA__ACZ98331

SEQ ID NO: 170397 - RNA, 1410 nt, Artificial Sequence
  derived and/or modified sequence opt4 from neuraminidase__InfluenzaA__ACZ98341
augaaccccaaccagaagaucaucaccaucggcagcgugugcaucaccaucggcauggccaaccugauccugcagaucggcaacaucaucagcaucuggaucagccaccccauccagcugggcaaccagaaccagaucgagaccugcaaccagagcgugaucaccuacgagaacaacaccugggugaaccagaccuacgugaacaucagcaacaccaaccuggccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170398 - RNA, 1410 nt, Artificial Sequence; identical to SEQ ID NO: 169258
  derived and/or modified sequence opt4 from neuraminidase__InfluenzaA__ACZ98351

SEQ ID NO: 170399 - RNA, 1410 nt, Artificial Sequence; identical to SEQ ID NO: 169258
  derived and/or modified sequence opt4 from neuraminidase__InfluenzaA__ACZ98361

SEQ ID NO: 170400 - RNA, 1410 nt, Artificial Sequence; identical to SEQ ID NO: 169258
  derived and/or modified sequence opt4 from neuraminidase__InfluenzaA__ACZ98371

SEQ ID NO: 170401 - RNA, 1410 nt, Artificial Sequence; identical to SEQ ID NO: 169258
  derived and/or modified sequence opt4 from neuraminidase__InfluenzaA__ACZ98381

SEQ ID NO: 170402 - RNA, 1410 nt, Artificial Sequence; identical to SEQ ID NO: 169258
  derived and/or modified sequence opt4 from neuraminidase__InfluenzaA__ACZ98391

SEQ ID NO: 170403 - RNA, 1410 nt, Artificial Sequence; identical to SEQ ID NO: 169258
  derived and/or modified sequence opt4 from neuraminidase__InfluenzaA__ACZ98401

SEQ ID NO: 170404 - RNA, 1410 nt, Artificial Sequence; identical to SEQ ID NO: 169258
  derived and/or modified sequence opt4 from neuraminidase__InfluenzaA__ACZ98411

SEQ ID NO: 170405 - RNA, 1410 nt, Artificial Sequence; identical to SEQ ID NO: 169288
  derived and/or modified sequence opt4 from neuraminidase__InfluenzaA__ACZ98421

SEQ ID NO: 170406 - RNA, 1410 nt, Artificial Sequence; identical to SEQ ID NO: 169258
  derived and/or modified sequence opt4 from neuraminidase__InfluenzaA__ACZ98431

SEQ ID NO: 170407 - RNA, 1410 nt, Artificial Sequence; identical to SEQ ID NO: 169258
  derived and/or modified sequence opt4 from neuraminidase__InfluenzaA__ACZ98441

SEQ ID NO: 170408 - RNA, 1410 nt, Artificial Sequence; identical to SEQ ID NO: 169258
  derived and/or modified sequence opt4 from neuraminidase__InfluenzaA__ACZ98451

SEQ ID NO: 170409 - RNA, 1410 nt, Artificial Sequence; identical to SEQ ID NO: 169258
  derived and/or modified sequence opt4 from neuraminidase__InfluenzaA__ACZ98461

SEQ ID NO: 170410 - RNA, 1410 nt, Artificial Sequence; identical to SEQ ID NO: 169841
  derived and/or modified sequence opt4 from neuraminidase__InfluenzaA__ACZ98674

SEQ ID NO: 170411 - RNA, 1410 nt, Artificial Sequence; identical to SEQ ID NO: 170365
  derived and/or modified sequence opt4 from neuraminidase__InfluenzaA__ACZ98684

SEQ ID NO: 170412 - RNA, 1410 nt, Artificial Sequence; identical to SEQ ID NO: 170311
  derived and/or modified sequence opt4 from neuraminidase__InfluenzaA__ACZ98694

SEQ ID NO: 170413 - RNA, 1410 nt, Artificial Sequence; identical to SEQ ID NO: 169258
  derived and/or modified sequence opt4 from neuraminidase__InfluenzaA__ADA60801

SEQ ID NO: 170414 - RNA, 1410 nt, Artificial Sequence; identical to SEQ ID NO: 169258
  derived and/or modified sequence opt4 from neuraminidase__InfluenzaA__ADA69294

SEQ ID NO: 170415 - RNA, 1410 nt, Artificial Sequence; identical to SEQ ID NO: 169258
  derived and/or modified sequence opt4 from neuraminidase__InfluenzaA__ADA69304

SEQ ID NO: 170416 - RNA, 1410 nt, Artificial Sequence; identical to SEQ ID NO: 169258
  derived and/or modified sequence opt4 from neuraminidase__InfluenzaA__ADA69314

SEQ ID NO: 170417 - RNA, 1410 nt, Artificial Sequence; identical to SEQ ID NO: 169258
  derived and/or modified sequence opt4 from neuraminidase__InfluenzaA__ADA69324

SEQ ID NO: 170418 - RNA, 1410 nt, Artificial Sequence; identical to SEQ ID NO: 169258
  derived and/or modified sequence opt4 from neuraminidase__InfluenzaA__ADA69334

SEQ ID NO: 170419 - RNA, 1410 nt, Artificial Sequence; identical to SEQ ID NO: 169258
  derived and/or modified sequence opt4 from neuraminidase__InfluenzaA__ADA69451

SEQ ID NO: 170420 - RNA, 1410 nt, Artificial Sequence; identical to SEQ ID NO: 169258
  derived and/or modified sequence opt4 from neuraminidase__InfluenzaA__ADA69453

SEQ ID NO: 170421 - RNA, 1410 nt, Artificial Sequence
  derived and/or modified sequence opt4 from neuraminidase__InfluenzaA__ADA71153
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacccccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 170422 - RNA, 1413 nt, Artificial Sequence
  derived and/or modified sequence opt4 from neuraminidase__InfluenzaA__ADA71155
augaaccccaaccagaagaucaucaccaucggcagcaucagcaucgccaucggcaucaucagccugaugcugcagaucggcaacaucaucagcaucugggccagccacagcauccagaucggcagccagaacaacaccggcaucugcaaccagagaaucaucaccuacgagaacagcaccugggugaaccacaccuacgugaacaucaacaacaccaaggugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170423 - RNA, 1413 nt, Artificial Sequence; identical to SEQ ID NO: 169981
  derived and/or modified sequence opt4 from neuraminidase__InfluenzaA__ADA71157

SEQ ID NO: 170424 - RNA, 1413 nt, Artificial Sequence
  derived and/or modified sequence opt4 from neuraminidase__InfluenzaA__ADA71159
augaaccccaaccagaagaucaucaccaucggcagcaucagcaucgccaucggcaucaucagccugaugcugcagaucggcaacaucaucagcaucugggccagccacagcauccagaucggcagccagaacaacaccggcaucugcaaccagagaaucaucaccuacgagaacagcaccugggugaaccacaccuacgugaacaucaacaacaccaaggugguggccggcgagggcaagaccagcgugacccuggccggcaacagcagccugugcagcaucagcggcugggccaucaacaccaaggacaacagcaucagaaucggcagcaagggcgacguguucgugaucagagagcccuucaucagcugcagccaccuggagugcagaaccuucuuccugacccagggcgcccugcugaacgacaagcacagcaacagaaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170425 - RNA, 1410 nt, Artificial Sequence
  derived and/or modified sequence opt4 from neuraminidase__InfluenzaA__ADA71161
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 170426 - RNA, 1413 nt, Artificial Sequence
  derived and/or modified sequence opt4 from neuraminidase__InfluenzaA__ADA71165
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucagcaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170427 - RNA, 1410 nt, Artificial Sequence
  derived and/or modified sequence opt4 from neuraminidase__InfluenzaA__ADA71167
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 170428 - RNA, 1413 nt, Artificial Sequence
  derived and/or modified sequence opt4 from neuraminidase__InfluenzaA__ADA71169
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggugggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaagggcaucaucaccggcaccaucaagagcuggaagaagcagauccugagaacccaggagagcgagugcgugugcaucaacggcagcugcuucaccaucaugaccgacggccccagcgacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 170429 - RNA, 1413 nt, Artificial Sequence; identical to SEQ ID NO: 169981
  derived and/or modified sequence opt4 from neuraminidase__InfluenzaA__ADA71171

SEQ ID NO: 170430 - RNA, 1410 nt, Artificial Sequence
  derived and/or modified sequence opt4 from neuraminidase__InfluenzaA__ADA71173
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagccagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 170431 - RNA, 1413 nt, Artificial Sequence
  derived and/or modified sequence opt4 from neuraminidase__InfluenzaA__ADA71175
augaaccccaaccagaagaucaucaccaucggcagcaucagcaucgccaucggcaucaucagccugaugcugcagaucggcaacaucaucagcaucugggccagccacagcauccagaucggcagccagaacaacaccggcaucugcaaccagagaaucaucaccuacgagaacagcaccugggugaaccacaccuacgugaacaucaacaacaccaaggugguggccggcgaggacaagaccagcgugacccuggccggcaacagcagccugugcagcaucagcggcugggccaucaacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170432 - RNA, 1413 nt, Artificial Sequence; identical to SEQ ID NO: 169981
  derived and/or modified sequence opt4 from neuraminidase__InfluenzaA__ADA71177

SEQ ID NO: 170433 - RNA, 1410 nt, Artificial Sequence
  derived and/or modified sequence opt4 from neuraminidase__InfluenzaA__ADA71193
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagguggugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170434 - RNA, 1410 nt, Artificial Sequence
  derived and/or modified sequence opt4 from neuraminidase__InfluenzaA__ADA79589
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcagcagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaagagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170435 - RNA, 1410 nt, Artificial Sequence
  derived and/or modified sequence opt4 from neuraminidase__InfluenzaA__ADA79599
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170436 - RNA, 1410 nt, Artificial Sequence; identical to SEQ ID NO: 170435
  derived and/or modified sequence opt4 from neuraminidase__InfluenzaA__ADA79609

SEQ ID NO: 170437 - RNA, 1410 nt, Artificial Sequence
  derived and/or modified sequence opt4 from neuraminidase__InfluenzaA__ADA79619
augaaccccaaccagaagaucaucaccaucggcagcaucugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggccagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170438 - RNA, 1410 nt, Artificial Sequence; identical to SEQ ID NO: 169258
  derived and/or modified sequence opt4 from neuraminidase__InfluenzaA__ADA81211

SEQ ID NO: 170439 - RNA, 1410 nt, Artificial Sequence
  derived and/or modified sequence opt4 from neuraminidase__InfluenzaA__ADA83035
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagcaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170440 - RNA, 1410 nt, Artificial Sequence
  derived and/or modified sequence opt4 from neuraminidase__InfluenzaA__ADA83037
augaaccccaaccagaagaucaucaccaucggcagcgugugcaugaccaucggcauggccaaccugauccugcagaucggcaacaucaucagcaucuggaucagccacagcauccagcugggcaaccaggaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170441 - RNA, 1410 nt, Artificial Sequence; identical to SEQ ID NO: 169258
  derived and/or modified sequence opt4 from neuraminidase__InfluenzaA__ADA83588

SEQ ID NO: 170442 - RNA, 1410 nt, Artificial Sequence; identical to SEQ ID NO: 169258
  derived and/or modified sequence opt4 from neuraminidase__InfluenzaA__ADA83592

SEQ ID NO: 170443 - RNA, 1410 nt, Artificial Sequence; identical to SEQ ID NO: 169258
  derived and/or modified sequence opt4 from neuraminidase__InfluenzaA__ADA83596

SEQ ID NO: 170444 - RNA, 1410 nt, Artificial Sequence; identical to SEQ ID NO: 169258
  derived and/or modified sequence opt4 from neuraminidase__InfluenzaA__ADA83600

SEQ ID NO: 170445 - RNA, 1410 nt, Artificial Sequence; identical to SEQ ID NO: 169258
  derived and/or modified sequence opt4 from neuraminidase__InfluenzaA__ADA83604

SEQ ID NO: 170446 - RNA, 1410 nt, Artificial Sequence; identical to SEQ ID NO: 169258
  derived and/or modified sequence opt4 from neuraminidase__InfluenzaA__ADA83608

SEQ ID NO: 170447 - RNA, 1410 nt, Artificial Sequence; identical to SEQ ID NO: 169258
  derived and/or modified sequence opt4 from neuraminidase__InfluenzaA__ADA83612

SEQ ID NO: 170448 - RNA, 1410 nt, Artificial Sequence; identical to SEQ ID NO: 169612
  derived and/or modified sequence opt4 from neuraminidase__InfluenzaA__ADA83616

SEQ ID NO: 170449 - RNA, 1410 nt, Artificial Sequence; identical to SEQ ID NO: 169258
  derived and/or modified sequence opt4 from neuraminidase__InfluenzaA__ADA83624

SEQ ID NO: 170450 - RNA, 1410 nt, Artificial Sequence; identical to SEQ ID NO: 169258
  derived and/or modified sequence opt4 from neuraminidase__InfluenzaA__ADA83630

SEQ ID NO: 170451 - RNA, 1410 nt, Artificial Sequence; identical to SEQ ID NO: 169258
  derived and/or modified sequence opt4 from neuraminidase__InfluenzaA__ADA83634

SEQ ID NO: 170452 - RNA, 1410 nt, Artificial Sequence; identical to SEQ ID NO: 169258
  derived and/or modified sequence opt4 from neuraminidase__InfluenzaA__ADA83638

SEQ ID NO: 170453 - RNA, 1410 nt, Artificial Sequence; identical to SEQ ID NO: 169258
  derived and/or modified sequence opt4 from neuraminidase__InfluenzaA__ADA83642

SEQ ID NO: 170454 - RNA, 1410 nt, Artificial Sequence; identical to SEQ ID NO: 169258
  derived and/or modified sequence opt4 from neuraminidase__InfluenzaA__ADA83649

SEQ ID NO: 170455 - RNA, 1410 nt, Artificial Sequence; identical to SEQ ID NO: 169258
  derived and/or modified sequence opt4 from neuraminidase__InfluenzaA__ADA83653

SEQ ID NO: 170456 - RNA, 1410 nt, Artificial Sequence; identical to SEQ ID NO: 169258
  derived and/or modified sequence opt4 from neuraminidase__InfluenzaA__ADA83657

SEQ ID NO: 170457 - RNA, 1410 nt, Artificial Sequence; identical to SEQ ID NO: 169258
  derived and/or modified sequence opt4 from neuraminidase__InfluenzaA__ADA83661

SEQ ID NO: 170458 - RNA, 1410 nt, Artificial Sequence; identical to SEQ ID NO: 169258
  derived and/or modified sequence opt4 from neuraminidase__InfluenzaA__ADA83669

SEQ ID NO: 170459 - RNA, 1410 nt, Artificial Sequence; identical to SEQ ID NO: 169258
  derived and/or modified sequence opt4 from neuraminidase__InfluenzaA__ADA83673

SEQ ID NO: 170460 - RNA, 1410 nt, Artificial Sequence; identical to SEQ ID NO: 169258
  derived and/or modified sequence opt4 from neuraminidase__InfluenzaA__ADA83677

SEQ ID NO: 170461 - RNA, 1410 nt, Artificial Sequence; identical to SEQ ID NO: 169258
  derived and/or modified sequence opt4 from neuraminidase__InfluenzaA__ADA83681

SEQ ID NO: 170462 - RNA, 1410 nt, Artificial Sequence; identical to SEQ ID NO: 169258
  derived and/or modified sequence opt4 from neuraminidase__InfluenzaA__ADA83685

SEQ ID NO: 170463 - RNA, 1410 nt, Artificial Sequence; identical to SEQ ID NO: 169258
  derived and/or modified sequence opt4 from neuraminidase__InfluenzaA__ADA86069

SEQ ID NO: 170464 - RNA, 1410 nt, Artificial Sequence; identical to SEQ ID NO: 169258
  derived and/or modified sequence opt4 from neuraminidase__InfluenzaA__ADB27973

SEQ ID NO: 170465 - RNA, 1410 nt, Artificial Sequence; identical to SEQ ID NO: 169258
  derived and/or modified sequence opt4 from neuraminidase__InfluenzaA__ADB27983

SEQ ID NO: 170466 - RNA, 1410 nt, Artificial Sequence
  derived and/or modified sequence opt4 from neuraminidase__InfluenzaA__ADB66693
augaaccccaaccagaagaucaucaccaucggcagcgugugcaugaccaucggcauggccaaccugauccugcagaucggcaacaucaucagcaucuggaucauccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170467 - RNA, 1410 nt, Artificial Sequence; identical to SEQ ID NO: 169258
  derived and/or modified sequence opt4 from neuraminidase__InfluenzaA__ADB66695

SEQ ID NO: 170468 - RNA, 1410 nt, Artificial Sequence; identical to SEQ ID NO: 169258
  derived and/or modified sequence opt4 from neuraminidase__InfluenzaA__ADB66696

SEQ ID NO: 170469 - RNA, 1410 nt, Artificial Sequence
  derived and/or modified sequence opt4 from neuraminidase__InfluenzaA__ADB66697
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacgagcaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcauccacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170470 - RNA, 1410 nt, Artificial Sequence; identical to SEQ ID NO: 170433
  derived and/or modified sequence opt4 from neuraminidase__InfluenzaA__ADB81401

SEQ ID NO: 170471 - RNA, 1410 nt, Artificial Sequence; identical to SEQ ID NO: 170276
  derived and/or modified sequence opt4 from neuraminidase__InfluenzaA__ADB81421

SEQ ID NO: 170472 - RNA, 1410 nt, Artificial Sequence; identical to SEQ ID NO: 169612
  derived and/or modified sequence opt4 from neuraminidase__InfluenzaA__ADB81431

SEQ ID NO: 170473 - RNA, 1410 nt, Artificial Sequence; identical to SEQ ID NO: 169258
  derived and/or modified sequence opt4 from neuraminidase__InfluenzaA__ADB81441

SEQ ID NO: 170474 - RNA, 1410 nt, Artificial Sequence
  derived and/or modified sequence opt4 from neuraminidase__InfluenzaA__ADB81451
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170475 - RNA, 1410 nt, Artificial Sequence; identical to SEQ ID NO: 170435
  derived and/or modified sequence opt4 from neuraminidase__InfluenzaA__ADB81461

SEQ ID NO: 170476 - RNA, 1410 nt, Artificial Sequence; identical to SEQ ID NO: 170435
  derived and/or modified sequence opt4 from neuraminidase__InfluenzaA__ADB82942

SEQ ID NO: 170477 - RNA, 1410 nt, Artificial Sequence; identical to SEQ ID NO: 169413
  derived and/or modified sequence opt4 from neuraminidase__InfluenzaA__ADB82945

SEQ ID NO: 170478 - RNA, 1410 nt, Artificial Sequence; identical to SEQ ID NO: 169258
  derived and/or modified sequence opt4 from neuraminidase__InfluenzaA__ADB89132

SEQ ID NO: 170479 - RNA, 1410 nt, Artificial Sequence; identical to SEQ ID NO: 169841
  derived and/or modified sequence opt4 from neuraminidase__InfluenzaA__ADB89142

SEQ ID NO: 170480 - RNA, 1410 nt, Artificial Sequence; identical to SEQ ID NO: 169258
  derived and/or modified sequence opt4 from neuraminidase__InfluenzaA__ADB89224

SEQ ID NO: 170481 - RNA, 1410 nt, Artificial Sequence
  derived and/or modified sequence opt4 from neuraminidase__InfluenzaA__ADB89234
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggugggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170482 - RNA, 1410 nt, Artificial Sequence; identical to SEQ ID NO: 169248
  derived and/or modified sequence opt4 from neuraminidase__InfluenzaA__ADB89244

SEQ ID NO: 170483 - RNA, 1410 nt, Artificial Sequence; identical to SEQ ID NO: 169258
  derived and/or modified sequence opt4 from neuraminidase__InfluenzaA__ADB89264

SEQ ID NO: 170484 - RNA, 1410 nt, Artificial Sequence; identical to SEQ ID NO: 170228
  derived and/or modified sequence opt4 from neuraminidase__InfluenzaA__ADB89274

SEQ ID NO: 170485 - RNA, 1410 nt, Artificial Sequence; identical to SEQ ID NO: 169413
  derived and/or modified sequence opt4 from neuraminidase__InfluenzaA__ADB89284

SEQ ID NO: 170486 - RNA, 1410 nt, Artificial Sequence; identical to SEQ ID NO: 169258
  derived and/or modified sequence opt4 from neuraminidase__InfluenzaA__ADB89294

SEQ ID NO: 170487 - RNA, 1410 nt, Artificial Sequence; identical to SEQ ID NO: 169258
  derived and/or modified sequence opt4 from neuraminidase__InfluenzaA__ADB89304

SEQ ID NO: 170488 - RNA, 1410 nt, Artificial Sequence; identical to SEQ ID NO: 169258
  derived and/or modified sequence opt4 from neuraminidase__InfluenzaA__ADB89314

SEQ ID NO: 170489 - RNA, 1410 nt, Artificial Sequence; identical to SEQ ID NO: 169258
  derived and/or modified sequence opt4 from neuraminidase__InfluenzaA__ADB89324

SEQ ID NO: 170490 - RNA, 1410 nt, Artificial Sequence; identical to SEQ ID NO: 169258
  derived and/or modified sequence opt4 from neuraminidase__InfluenzaA__ADB89334

SEQ ID NO: 170491 - RNA, 1410 nt, Artificial Sequence; identical to SEQ ID NO: 169258
  derived and/or modified sequence opt4 from neuraminidase__InfluenzaA__ADB89344

SEQ ID NO: 170492 - RNA, 1410 nt, Artificial Sequence; identical to SEQ ID NO: 169258
  derived and/or modified sequence opt4 from neuraminidase__InfluenzaA__ADB89364

SEQ ID NO: 170493 - RNA, 1410 nt, Artificial Sequence; identical to SEQ ID NO: 169258
  derived and/or modified sequence opt4 from neuraminidase__InfluenzaA__ADB89374

SEQ ID NO: 170494 - RNA, 1410 nt, Artificial Sequence; identical to SEQ ID NO: 169258
  derived and/or modified sequence opt4 from neuraminidase__InfluenzaA__ADB89384

SEQ ID NO: 170495 - RNA, 1410 nt, Artificial Sequence; identical to SEQ ID NO: 169258
  derived and/or modified sequence opt4 from neuraminidase__InfluenzaA__ADB89394

SEQ ID NO: 170496 - RNA, 1410 nt, Artificial Sequence
  derived and/or modified sequence opt4 from neuraminidase__InfluenzaA__ADB89404
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacagcauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170497 - RNA, 1410 nt, Artificial Sequence; identical to SEQ ID NO: 169258
  derived and/or modified sequence opt4 from neuraminidase__InfluenzaA__ADB89414

SEQ ID NO: 170498 - RNA, 1410 nt, Artificial Sequence; identical to SEQ ID NO: 169258
  derived and/or modified sequence opt4 from neuraminidase__InfluenzaA__ADB89424

SEQ ID NO: 170499 - RNA, 1410 nt, Artificial Sequence; identical to SEQ ID NO: 169258
  derived and/or modified sequence opt4 from neuraminidase__InfluenzaA__ADB89434

SEQ ID NO: 170500 - RNA, 1410 nt, Artificial Sequence; identical to SEQ ID NO: 169258
  derived and/or modified sequence opt4 from neuraminidase__InfluenzaA__ADB89444

SEQ ID NO: 170501 - RNA, 1410 nt, Artificial Sequence
  derived and/or modified sequence opt4 from neuraminidase__InfluenzaA__ADB89454
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccaacgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170502 - RNA, 1410 nt, Artificial Sequence; identical to SEQ ID NO: 169258
  derived and/or modified sequence opt4 from neuraminidase__InfluenzaA__ADB89464

SEQ ID NO: 170503 - RNA, 1410 nt, Artificial Sequence; identical to SEQ ID NO: 169258
  derived and/or modified sequence opt4 from neuraminidase__InfluenzaA__ADB89484

SEQ ID NO: 170504 - RNA, 1410 nt, Artificial Sequence; identical to SEQ ID NO: 169258
  derived and/or modified sequence opt4 from neuraminidase__InfluenzaA__ADB89494

SEQ ID NO: 170505 - RNA, 1410 nt, Artificial Sequence; identical to SEQ ID NO: 169248
  derived and/or modified sequence opt4 from neuraminidase__InfluenzaA__ADB89504

SEQ ID NO: 170506 - RNA, 1410 nt, Artificial Sequence; identical to SEQ ID NO: 169258
  derived and/or modified sequence opt4 from neuraminidase__InfluenzaA__ADB89514

SEQ ID NO: 170507 - RNA, 1410 nt, Artificial Sequence; identical to SEQ ID NO: 169258
  derived and/or modified sequence opt4 from neuraminidase__InfluenzaA__ADB89524

SEQ ID NO: 170508 - RNA, 1410 nt, Artificial Sequence
  derived and/or modified sequence opt4 from neuraminidase__InfluenzaA__ADB89544
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccugcuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170509 - RNA, 1410 nt, Artificial Sequence; identical to SEQ ID NO: 169258
  derived and/or modified sequence opt4 from neuraminidase__InfluenzaA__ADB89564

SEQ ID NO: 170510 - RNA, 1410 nt, Artificial Sequence; identical to SEQ ID NO: 169258
  derived and/or modified sequence opt4 from neuraminidase__InfluenzaA__ADB89574

SEQ ID NO: 170511 - RNA, 1410 nt, Artificial Sequence; identical to SEQ ID NO: 169258
  derived and/or modified sequence opt4 from neuraminidase__InfluenzaA__ADB89594

SEQ ID NO: 170512 - RNA, 1410 nt, Artificial Sequence; identical to SEQ ID NO: 169258
  derived and/or modified sequence opt4 from neuraminidase__InfluenzaA__ADB89604

SEQ ID NO: 170513 - RNA, 1410 nt, Artificial Sequence
  derived and/or modified sequence opt4 from neuraminidase__InfluenzaA__ADB89614
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcaucuggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170514 - RNA, 1410 nt, Artificial Sequence; identical to SEQ ID NO: 169258
  derived and/or modified sequence opt4 from neuraminidase__InfluenzaA__ADB89624

SEQ ID NO: 170515 - RNA, 1410 nt, Artificial Sequence; identical to SEQ ID NO: 169258
  derived and/or modified sequence opt4 from neuraminidase__InfluenzaA__ADB89634

SEQ ID NO: 170516 - RNA, 1410 nt, Artificial Sequence; identical to SEQ ID NO: 169258
  derived and/or modified sequence opt4 from neuraminidase__InfluenzaA__ADB89644

SEQ ID NO: 170517 - RNA, 1410 nt, Artificial Sequence; identical to SEQ ID NO: 170276
  derived and/or modified sequence opt4 from neuraminidase__InfluenzaA__ADB89664

SEQ ID NO: 170518 - RNA, 1410 nt, Artificial Sequence; identical to SEQ ID NO: 169258
  derived and/or modified sequence opt4 from neuraminidase__InfluenzaA__ADB89674

SEQ ID NO: 170519 - RNA, 1410 nt, Artificial Sequence; identical to SEQ ID NO: 169258
  derived and/or modified sequence opt4 from neuraminidase__InfluenzaA__ADB89684

SEQ ID NO: 170520 - RNA, 1410 nt, Artificial Sequence
  derived and/or modified sequence opt4 from neuraminidase__InfluenzaA__ADB89694
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucaccaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170521 - RNA, 1410 nt, Artificial Sequence; identical to SEQ ID NO: 169258
  derived and/or modified sequence opt4 from neuraminidase__InfluenzaA__ADB89704

SEQ ID NO: 170522 - RNA, 1410 nt, Artificial Sequence; identical to SEQ ID NO: 169258
  derived and/or modified sequence opt4 from neuraminidase__InfluenzaA__ADB89714

SEQ ID NO: 170523 - RNA, 1410 nt, Artificial Sequence; identical to SEQ ID NO: 169119
  derived and/or modified sequence opt4 from neuraminidase__InfluenzaA__ADB89724

SEQ ID NO: 170524 - RNA, 1410 nt, Artificial Sequence; identical to SEQ ID NO: 169119
  derived and/or modified sequence opt4 from neuraminidase__InfluenzaA__ADB89735

SEQ ID NO: 170525 - RNA, 1410 nt, Artificial Sequence; identical to SEQ ID NO: 169258
  derived and/or modified sequence opt4 from neuraminidase__InfluenzaA__ADB90357

SEQ ID NO: 170526 - RNA, 1410 nt, Artificial Sequence; identical to SEQ ID NO: 169258
  derived and/or modified sequence opt4 from neuraminidase__InfluenzaA__ADB90358

SEQ ID NO: 170527 - RNA, 1410 nt, Artificial Sequence
  derived and/or modified sequence opt4 from neuraminidase__InfluenzaA__ADB90359
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170528 - RNA, 1410 nt, Artificial Sequence; identical to SEQ ID NO: 169258
  derived and/or modified sequence opt4 from neuraminidase__InfluenzaA__ADB90363

SEQ ID NO: 170529 - RNA, 1410 nt, Artificial Sequence; identical to SEQ ID NO: 170435
  derived and/or modified sequence opt4 from neuraminidase__InfluenzaA__ADB90373

SEQ ID NO: 170530 - RNA, 1410 nt, Artificial Sequence; identical to SEQ ID NO: 169258
  derived and/or modified sequence opt4 from neuraminidase__InfluenzaA__ADB98137

SEQ ID NO: 170531 - RNA, 1410 nt, Artificial Sequence; identical to SEQ ID NO: 169612
  derived and/or modified sequence opt4 from neuraminidase__InfluenzaA__ADB98138

SEQ ID NO: 170532 - RNA, 1410 nt, Artificial Sequence; identical to SEQ ID NO: 169258
  derived and/or modified sequence opt4 from neuraminidase__InfluenzaA__ADB98139

SEQ ID NO: 170533 - RNA, 1410 nt, Artificial Sequence; identical to SEQ ID NO: 169612
  derived and/or modified sequence opt4 from neuraminidase__InfluenzaA__ADB98140

SEQ ID NO: 170534 - RNA, 1410 nt, Artificial Sequence; identical to SEQ ID NO: 169612
  derived and/or modified sequence opt4 from neuraminidase__InfluenzaA__ADB98141

SEQ ID NO: 170535 - RNA, 1410 nt, Artificial Sequence; identical to SEQ ID NO: 169258
  derived and/or modified sequence opt4 from neuraminidase__InfluenzaA__ADC32391

SEQ ID NO: 170536 - RNA, 1410 nt, Artificial Sequence; identical to SEQ ID NO: 169258
  derived and/or modified sequence opt4 from neuraminidase__InfluenzaA__ADC32392

SEQ ID NO: 170537 - RNA, 1410 nt, Artificial Sequence; identical to SEQ ID NO: 169258
  derived and/or modified sequence opt4 from neuraminidase__InfluenzaA__ADC32393

SEQ ID NO: 170538 - RNA, 1410 nt, Artificial Sequence; identical to SEQ ID NO: 169258
  derived and/or modified sequence opt4 from neuraminidase__InfluenzaA__ADC32394

SEQ ID NO: 170539 - RNA, 1410 nt, Artificial Sequence; identical to SEQ ID NO: 169258
  derived and/or modified sequence opt4 from neuraminidase__InfluenzaA__ADC32395

SEQ ID NO: 170540 - RNA, 1410 nt, Artificial Sequence; identical to SEQ ID NO: 169258
  derived and/or modified sequence opt4 from neuraminidase__InfluenzaA__ADC32396

SEQ ID NO: 170541 - RNA, 1410 nt, Artificial Sequence; identical to SEQ ID NO: 169258
  derived and/or modified sequence opt4 from neuraminidase__InfluenzaA__ADC32397

SEQ ID NO: 170542 - RNA, 1410 nt, Artificial Sequence; identical to SEQ ID NO: 169258
  derived and/or modified sequence opt4 from neuraminidase__InfluenzaA__ADC32398

SEQ ID NO: 170543 - RNA, 1410 nt, Artificial Sequence; identical to SEQ ID NO: 169258
  derived and/or modified sequence opt4 from neuraminidase__InfluenzaA__ADC32399

SEQ ID NO: 170544 - RNA, 1410 nt, Artificial Sequence; identical to SEQ ID NO: 169258
  derived and/or modified sequence opt4 from neuraminidase__InfluenzaA__ADC32400

SEQ ID NO: 170545 - RNA, 1410 nt, Artificial Sequence; identical to SEQ ID NO: 169258
  derived and/or modified sequence opt4 from neuraminidase__InfluenzaA__ADC32401

SEQ ID NO: 170546 - RNA, 1410 nt, Artificial Sequence
  derived and/or modified sequence opt4 from neuraminidase__InfluenzaA__ADC32404
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170547 - RNA, 1410 nt, Artificial Sequence
  derived and/or modified sequence opt4 from neuraminidase__InfluenzaA__ADC32407
augaaccccaagcagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170548 - RNA, 1410 nt, Artificial Sequence
  derived and/or modified sequence opt4 from neuraminidase__InfluenzaA__ADC34942
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagagaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaucgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggagaggcagcaacagacccaucguggacaucaacaugaaggacuacagcaucgugagcagcuacgugugcagcggccuggugggcgacacccccagaaagaacgacagcagcagcagcggccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 170549 - RNA, 1410 nt, Artificial Sequence
  derived and/or modified sequence opt4 from neuraminidase__InfluenzaA__ADC39000
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaacgugggcuggagcuggcccgacggcgccgagcugcccuucaccaucgacaaguga

SEQ ID NO: 170550 - RNA, 1410 nt, Artificial Sequence; identical to SEQ ID NO: 169258
  derived and/or modified sequence opt4 from neuraminidase__InfluenzaA__ADC39010

SEQ ID NO: 170551 - RNA, 1413 nt, Artificial Sequence; identical to SEQ ID NO: 169152
  derived and/or modified sequence opt4 from neuraminidase__InfluenzaA__ADC45606

SEQ ID NO: 170552 - RNA, 1413 nt, Artificial Sequence
  derived and/or modified sequence opt4 from neuraminidase__InfluenzaA__ADC45628
augaaccccaaccagaagaucaucaccaucggcagcaucagcaucgccaucggcaucaucagccugaugcugcagaugggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggugggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaagggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 170553 - RNA, 1413 nt, Artificial Sequence
  derived and/or modified sequence opt4 from neuraminidase__InfluenzaA__ADC45639
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggugggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcgugagcggccccgacaacggcgccguggccgugcugaaguacaagggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 170554 - RNA, 1413 nt, Artificial Sequence; identical to SEQ ID NO: 169152
  derived and/or modified sequence opt4 from neuraminidase__InfluenzaA__ADC45650

SEQ ID NO: 170555 - RNA, 1413 nt, Artificial Sequence; identical to SEQ ID NO: 169152
  derived and/or modified sequence opt4 from neuraminidase__InfluenzaA__ADC45661

SEQ ID NO: 170556 - RNA, 1413 nt, Artificial Sequence
  derived and/or modified sequence opt4 from neuraminidase__InfluenzaA__ADC45683
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcgaggacaagacccccgugacccuggugggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaagggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 170557 - RNA, 1413 nt, Artificial Sequence
  derived and/or modified sequence opt4 from neuraminidase__InfluenzaA__ADC45705
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaagaacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170558 - RNA, 1413 nt, Artificial Sequence
  derived and/or modified sequence opt4 from neuraminidase__InfluenzaA__ADC45716
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggugggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaagggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccaacggcguggagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccaacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 170559 - RNA, 1413 nt, Artificial Sequence
  derived and/or modified sequence opt4 from neuraminidase__InfluenzaA__ADC45738
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170560 - RNA, 1413 nt, Artificial Sequence
  derived and/or modified sequence opt4 from neuraminidase__InfluenzaA__ADC45760
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccugggcugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170561 - RNA, 1413 nt, Artificial Sequence
  derived and/or modified sequence opt4 from neuraminidase__InfluenzaA__ADC45771
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcaugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170562 - RNA, 1413 nt, Artificial Sequence
  derived and/or modified sequence opt4 from neuraminidase__InfluenzaA__ADC45782
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacagaaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcgugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170563 - RNA, 1413 nt, Artificial Sequence
  derived and/or modified sequence opt4 from neuraminidase__InfluenzaA__ADC45804
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaagaucaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170564 - RNA, 1413 nt, Artificial Sequence
  derived and/or modified sequence opt4 from neuraminidase__InfluenzaA__ADC45815
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccgugaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcauggugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170565 - RNA, 1413 nt, Artificial Sequence; identical to SEQ ID NO: 169981
  derived and/or modified sequence opt4 from neuraminidase__InfluenzaA__ADC45837

SEQ ID NO: 170566 - RNA, 1413 nt, Artificial Sequence; identical to SEQ ID NO: 169981
  derived and/or modified sequence opt4 from neuraminidase__InfluenzaA__ADC45848

SEQ ID NO: 170567 - RNA, 1410 nt, Artificial Sequence; identical to SEQ ID NO: 169258
  derived and/or modified sequence opt4 from neuraminidase__InfluenzaA__ADC53559

SEQ ID NO: 170568 - RNA, 1410 nt, Artificial Sequence; identical to SEQ ID NO: 169258
  derived and/or modified sequence opt4 from neuraminidase__InfluenzaA__ADD14088

SEQ ID NO: 170569 - RNA, 1410 nt, Artificial Sequence; identical to SEQ ID NO: 169258
  derived and/or modified sequence opt4 from neuraminidase__InfluenzaA__ADD14090

SEQ ID NO: 170570 - RNA, 1410 nt, Artificial Sequence; identical to SEQ ID NO: 169258
  derived and/or modified sequence opt4 from neuraminidase__InfluenzaA__ADD14094

SEQ ID NO: 170571 - RNA, 1410 nt, Artificial Sequence; identical to SEQ ID NO: 169258
  derived and/or modified sequence opt4 from neuraminidase__InfluenzaA__ADD14096

SEQ ID NO: 170572 - RNA, 1410 nt, Artificial Sequence; identical to SEQ ID NO: 169258
  derived and/or modified sequence opt4 from neuraminidase__InfluenzaA__ADD14098

SEQ ID NO: 170573 - RNA, 1410 nt, Artificial Sequence; identical to SEQ ID NO: 169258
  derived and/or modified sequence opt4 from neuraminidase__InfluenzaA__ADD14100

SEQ ID NO: 170574 - RNA, 1410 nt, Artificial Sequence; identical to SEQ ID NO: 169258
  derived and/or modified sequence opt4 from neuraminidase__InfluenzaA__ADD14102

SEQ ID NO: 170575 - RNA, 1410 nt, Artificial Sequence; identical to SEQ ID NO: 169258
  derived and/or modified sequence opt4 from neuraminidase__InfluenzaA__ADD14104

SEQ ID NO: 170576 - RNA, 1410 nt, Artificial Sequence; identical to SEQ ID NO: 169258
  derived and/or modified sequence opt4 from neuraminidase__InfluenzaA__ADD14106

SEQ ID NO: 170577 - RNA, 1410 nt, Artificial Sequence; identical to SEQ ID NO: 169258
  derived and/or modified sequence opt4 from neuraminidase__InfluenzaA__ADD14110

SEQ ID NO: 170578 - RNA, 1410 nt, Artificial Sequence; identical to SEQ ID NO: 169258
  derived and/or modified sequence opt4 from neuraminidase__InfluenzaA__ADD14112

SEQ ID NO: 170579 - RNA, 1410 nt, Artificial Sequence; identical to SEQ ID NO: 170228
  derived and/or modified sequence opt4 from neuraminidase__InfluenzaA__ADD14114

SEQ ID NO: 170580 - RNA, 1410 nt, Artificial Sequence; identical to SEQ ID NO: 169258
  derived and/or modified sequence opt4 from neuraminidase__InfluenzaA__ADD14116

SEQ ID NO: 170581 - RNA, 1410 nt, Artificial Sequence; identical to SEQ ID NO: 169258
  derived and/or modified sequence opt4 from neuraminidase__InfluenzaA__ADD14118

SEQ ID NO: 170582 - RNA, 1410 nt, Artificial Sequence; identical to SEQ ID NO: 169258
  derived and/or modified sequence opt4 from neuraminidase__InfluenzaA__ADD14120

SEQ ID NO: 170583 - RNA, 1410 nt, Artificial Sequence; identical to SEQ ID NO: 169258
  derived and/or modified sequence opt4 from neuraminidase__InfluenzaA__ADD14122

SEQ ID NO: 170584 - RNA, 1410 nt, Artificial Sequence; identical to SEQ ID NO: 169258
  derived and/or modified sequence opt4 from neuraminidase__InfluenzaA__ADD14124

SEQ ID NO: 170585 - RNA, 1410 nt, Artificial Sequence; identical to SEQ ID NO: 170317
  derived and/or modified sequence opt4 from neuraminidase__InfluenzaA__ADD14126

SEQ ID NO: 170586 - RNA, 1410 nt, Artificial Sequence; identical to SEQ ID NO: 169258
  derived and/or modified sequence opt4 from neuraminidase__InfluenzaA__ADD14128

SEQ ID NO: 170587 - RNA, 1410 nt, Artificial Sequence; identical to SEQ ID NO: 169258
  derived and/or modified sequence opt4 from neuraminidase__InfluenzaA__ADD14130

SEQ ID NO: 170588 - RNA, 1410 nt, Artificial Sequence; identical to SEQ ID NO: 169258
  derived and/or modified sequence opt4 from neuraminidase__InfluenzaA__ADD14132

SEQ ID NO: 170589 - RNA, 1410 nt, Artificial Sequence; identical to SEQ ID NO: 169258
  derived and/or modified sequence opt4 from neuraminidase__InfluenzaA__ADD14134

SEQ ID NO: 170590 - RNA, 1410 nt, Artificial Sequence; identical to SEQ ID NO: 169258
  derived and/or modified sequence opt4 from neuraminidase__InfluenzaA__ADD14136

SEQ ID NO: 170591 - RNA, 1410 nt, Artificial Sequence; identical to SEQ ID NO: 169258
  derived and/or modified sequence opt4 from neuraminidase__InfluenzaA__ADD14138

SEQ ID NO: 170592 - RNA, 1410 nt, Artificial Sequence; identical to SEQ ID NO: 169258
  derived and/or modified sequence opt4 from neuraminidase__InfluenzaA__ADD14142

SEQ ID NO: 170593 - RNA, 1410 nt, Artificial Sequence; identical to SEQ ID NO: 169258
  derived and/or modified sequence opt4 from neuraminidase__InfluenzaA__ADD14144

SEQ ID NO: 170594 - RNA, 1410 nt, Artificial Sequence; identical to SEQ ID NO: 169258
  derived and/or modified sequence opt4 from neuraminidase__InfluenzaA__ADD14146

SEQ ID NO: 170595 - RNA, 1410 nt, Artificial Sequence; identical to SEQ ID NO: 169258
  derived and/or modified sequence opt4 from neuraminidase__InfluenzaA__ADD14148

SEQ ID NO: 170596 - RNA, 1410 nt, Artificial Sequence
  derived and/or modified sequence opt4 from neuraminidase__InfluenzaA__ADD14150
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacgacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170597 - RNA, 1410 nt, Artificial Sequence; identical to SEQ ID NO: 169258
  derived and/or modified sequence opt4 from neuraminidase__InfluenzaA__ADD14152

SEQ ID NO: 170598 - RNA, 1410 nt, Artificial Sequence
  derived and/or modified sequence opt4 from neuraminidase__InfluenzaA__ADD14154
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaucaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170599 - RNA, 1410 nt, Artificial Sequence; identical to SEQ ID NO: 169258
  derived and/or modified sequence opt4 from neuraminidase__InfluenzaA__ADD14156

SEQ ID NO: 170600 - RNA, 1410 nt, Artificial Sequence; identical to SEQ ID NO: 169258
  derived and/or modified sequence opt4 from neuraminidase__InfluenzaA__ADD14158

SEQ ID NO: 170601 - RNA, 1410 nt, Artificial Sequence; identical to SEQ ID NO: 169258
  derived and/or modified sequence opt4 from neuraminidase__InfluenzaA__ADD14164

SEQ ID NO: 170602 - RNA, 1410 nt, Artificial Sequence; identical to SEQ ID NO: 169258
  derived and/or modified sequence opt4 from neuraminidase__InfluenzaA__ADD14174

SEQ ID NO: 170603 - RNA, 1410 nt, Artificial Sequence; identical to SEQ ID NO: 169258
  derived and/or modified sequence opt4 from neuraminidase__InfluenzaA__ADD14184

SEQ ID NO: 170604 - RNA, 1410 nt, Artificial Sequence; identical to SEQ ID NO: 169258
  derived and/or modified sequence opt4 from neuraminidase__InfluenzaA__ADD14194

SEQ ID NO: 170605 - RNA, 1410 nt, Artificial Sequence; identical to SEQ ID NO: 169612
  derived and/or modified sequence opt4 from neuraminidase__InfluenzaA__ADD14204

SEQ ID NO: 170606 - RNA, 1410 nt, Artificial Sequence
  derived and/or modified sequence opt4 from neuraminidase__InfluenzaA__ADD21449
augaaccccaaccagagaaucaucaccaucggcaccgccugccugaucaucggcaucgugagccugcugcugcagaucggcaacaucgugagccuguggaucagccacagcauccagaccggcgagaagaaccacagcgagaccugcaacagaaacaccaucaccuacgagaacagcaccugggugaaccagaccuacgugaacaucagcaacaucaacaucgccggcggccagggcguggccagcaucauccuggccggcaacagcagccugugccccgugaacggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacagaauccugagaacccaggagagcgagugcgugugcaucaacggcagcugcuucaccaucaugaccgacggccccagcaacggccaggccagcuacaagaucuucaagauggagagaggcaagaucaucaagagcguggagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucagcagcggcguguucggcgacaaccccagaagcaacgacggcaagggcaacugcggccccgugcugagcaacggcgccaacggcgugaagggccugagcuucagauacggcaacggcguguggaucggcagaaccaagagcaccaacagcagaagcggcuucgagaugaucugggaccccaacggcuggaccgagaccgacagcaacuucagcaugaagcaggacaucaucgcccugaccgacuggagcggcuacagcggcagcuucgugcagcaccccgagcugaccggcaugaacugcaucagacccugcuucuggguggagcugaucagaggccagcccaagcagagcaccaucuggaccagcggcagcagcaucagcuucugcggcguggacagcgagaccgccagcuggagcuggcccgacggcgccgaccugcccuucaccaucgacaaguga

SEQ ID NO: 170607 - RNA, 1413 nt, Artificial Sequence
  derived and/or modified sequence opt4 from neuraminidase__InfluenzaA__ADD21469
augaaccccaaccagaagaucaucaccaucggcagcaucagcaucgccaucggcaucaucagccugaugcugcagaucggcaacaucaucagcgugugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaaugcugagaacccaggagagcgagugcaucugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 170608 - RNA, 1410 nt, Artificial Sequence; identical to SEQ ID NO: 169258
  derived and/or modified sequence opt4 from neuraminidase__InfluenzaA__ADD21747

SEQ ID NO: 170609 - RNA, 1410 nt, Artificial Sequence
  derived and/or modified sequence opt4 from neuraminidase__InfluenzaA__ADD21767
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170610 - RNA, 1410 nt, Artificial Sequence
  derived and/or modified sequence opt4 from neuraminidase__InfluenzaA__ADD21777
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugaucaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170611 - RNA, 1410 nt, Artificial Sequence; identical to SEQ ID NO: 169258
  derived and/or modified sequence opt4 from neuraminidase__InfluenzaA__ADD21787

SEQ ID NO: 170612 - RNA, 1410 nt, Artificial Sequence; identical to SEQ ID NO: 169258
  derived and/or modified sequence opt4 from neuraminidase__InfluenzaA__ADD21797

SEQ ID NO: 170613 - RNA, 1410 nt, Artificial Sequence; identical to SEQ ID NO: 169258
  derived and/or modified sequence opt4 from neuraminidase__InfluenzaA__ADD21817

SEQ ID NO: 170614 - RNA, 1410 nt, Artificial Sequence; identical to SEQ ID NO: 169258
  derived and/or modified sequence opt4 from neuraminidase__InfluenzaA__ADD21827

SEQ ID NO: 170615 - RNA, 1410 nt, Artificial Sequence; identical to SEQ ID NO: 169258
  derived and/or modified sequence opt4 from neuraminidase__InfluenzaA__ADD21837

SEQ ID NO: 170616 - RNA, 1410 nt, Artificial Sequence; identical to SEQ ID NO: 169258
  derived and/or modified sequence opt4 from neuraminidase__InfluenzaA__ADD21847

SEQ ID NO: 170617 - RNA, 1410 nt, Artificial Sequence; identical to SEQ ID NO: 169258
  derived and/or modified sequence opt4 from neuraminidase__InfluenzaA__ADD21857

SEQ ID NO: 170618 - RNA, 1410 nt, Artificial Sequence; identical to SEQ ID NO: 169258
  derived and/or modified sequence opt4 from neuraminidase__InfluenzaA__ADD21867

SEQ ID NO: 170619 - RNA, 1410 nt, Artificial Sequence; identical to SEQ ID NO: 169258
  derived and/or modified sequence opt4 from neuraminidase__InfluenzaA__ADD21877

SEQ ID NO: 170620 - RNA, 1410 nt, Artificial Sequence; identical to SEQ ID NO: 169258
  derived and/or modified sequence opt4 from neuraminidase__InfluenzaA__ADD21897

SEQ ID NO: 170621 - RNA, 1410 nt, Artificial Sequence; identical to SEQ ID NO: 169258
  derived and/or modified sequence opt4 from neuraminidase__InfluenzaA__ADD22494

SEQ ID NO: 170622 - RNA, 1410 nt, Artificial Sequence; identical to SEQ ID NO: 169258
  derived and/or modified sequence opt4 from neuraminidase__InfluenzaA__ADD22504

SEQ ID NO: 170623 - RNA, 1410 nt, Artificial Sequence; identical to SEQ ID NO: 169258
  derived and/or modified sequence opt4 from neuraminidase__InfluenzaA__ADD22514

SEQ ID NO: 170624 - RNA, 1410 nt, Artificial Sequence; identical to SEQ ID NO: 169258
  derived and/or modified sequence opt4 from neuraminidase__InfluenzaA__ADD22524

SEQ ID NO: 170625 - RNA, 1410 nt, Artificial Sequence
  derived and/or modified sequence opt4 from neuraminidase__InfluenzaA__ADD22534
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacagccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170626 - RNA, 1410 nt, Artificial Sequence; identical to SEQ ID NO: 169258
  derived and/or modified sequence opt4 from neuraminidase__InfluenzaA__ADD22544

SEQ ID NO: 170627 - RNA, 1410 nt, Artificial Sequence; identical to SEQ ID NO: 169258
  derived and/or modified sequence opt4 from neuraminidase__InfluenzaA__ADD22557

SEQ ID NO: 170628 - RNA, 1410 nt, Artificial Sequence; identical to SEQ ID NO: 169258
  derived and/or modified sequence opt4 from neuraminidase__InfluenzaA__ADD22567

SEQ ID NO: 170629 - RNA, 1410 nt, Artificial Sequence; identical to SEQ ID NO: 169258
  derived and/or modified sequence opt4 from neuraminidase__InfluenzaA__ADD22577

SEQ ID NO: 170630 - RNA, 1410 nt, Artificial Sequence; identical to SEQ ID NO: 169258
  derived and/or modified sequence opt4 from neuraminidase__InfluenzaA__ADD22587

SEQ ID NO: 170631 - RNA, 1410 nt, Artificial Sequence; identical to SEQ ID NO: 169258
  derived and/or modified sequence opt4 from neuraminidase__InfluenzaA__ADD22597

SEQ ID NO: 170632 - RNA, 1410 nt, Artificial Sequence; identical to SEQ ID NO: 169258
  derived and/or modified sequence opt4 from neuraminidase__InfluenzaA__ADD22617

SEQ ID NO: 170633 - RNA, 1410 nt, Artificial Sequence; identical to SEQ ID NO: 169258
  derived and/or modified sequence opt4 from neuraminidase__InfluenzaA__ADD22627

SEQ ID NO: 170634 - RNA, 1410 nt, Artificial Sequence; identical to SEQ ID NO: 169258
  derived and/or modified sequence opt4 from neuraminidase__InfluenzaA__ADD22637

SEQ ID NO: 170635 - RNA, 1410 nt, Artificial Sequence; identical to SEQ ID NO: 169258
  derived and/or modified sequence opt4 from neuraminidase__InfluenzaA__ADD22648

SEQ ID NO: 170636 - RNA, 1410 nt, Artificial Sequence; identical to SEQ ID NO: 169258
  derived and/or modified sequence opt4 from neuraminidase__InfluenzaA__ADD22658

SEQ ID NO: 170637 - RNA, 1410 nt, Artificial Sequence; identical to SEQ ID NO: 169258
  derived and/or modified sequence opt4 from neuraminidase__InfluenzaA__ADD22668

SEQ ID NO: 170638 - RNA, 1410 nt, Artificial Sequence
  derived and/or modified sequence opt4 from neuraminidase__InfluenzaA__ADD22688
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggaucgagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170639 - RNA, 1410 nt, Artificial Sequence; identical to SEQ ID NO: 169258
  derived and/or modified sequence opt4 from neuraminidase__InfluenzaA__ADD22698

SEQ ID NO: 170640 - RNA, 1410 nt, Artificial Sequence; identical to SEQ ID NO: 169258
  derived and/or modified sequence opt4 from neuraminidase__InfluenzaA__ADD22725

SEQ ID NO: 170641 - RNA, 1410 nt, Artificial Sequence; identical to SEQ ID NO: 169258
  derived and/or modified sequence opt4 from neuraminidase__InfluenzaA__ADD22735

SEQ ID NO: 170642 - RNA, 1410 nt, Artificial Sequence; identical to SEQ ID NO: 169258
  derived and/or modified sequence opt4 from neuraminidase__InfluenzaA__ADD22745

SEQ ID NO: 170643 - RNA, 1410 nt, Artificial Sequence
  derived and/or modified sequence opt4 from neuraminidase__InfluenzaA__ADD22755
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugcaccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacagccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170644 - RNA, 1410 nt, Artificial Sequence
  derived and/or modified sequence opt4 from neuraminidase__InfluenzaA__ADD22765
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgacuggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170645 - RNA, 1410 nt, Artificial Sequence; identical to SEQ ID NO: 169258
  derived and/or modified sequence opt4 from neuraminidase__InfluenzaA__ADD22775

SEQ ID NO: 170646 - RNA, 1410 nt, Artificial Sequence; identical to SEQ ID NO: 169258
  derived and/or modified sequence opt4 from neuraminidase__InfluenzaA__ADD22785

SEQ ID NO: 170647 - RNA, 1410 nt, Artificial Sequence; identical to SEQ ID NO: 169258
  derived and/or modified sequence opt4 from neuraminidase__InfluenzaA__ADD22795

SEQ ID NO: 170648 - RNA, 1410 nt, Artificial Sequence; identical to SEQ ID NO: 169258
  derived and/or modified sequence opt4 from neuraminidase__InfluenzaA__ADD22805

SEQ ID NO: 170649 - RNA, 1410 nt, Artificial Sequence; identical to SEQ ID NO: 169258
  derived and/or modified sequence opt4 from neuraminidase__InfluenzaA__ADD22815

SEQ ID NO: 170650 - RNA, 1410 nt, Artificial Sequence; identical to SEQ ID NO: 169258
  derived and/or modified sequence opt4 from neuraminidase__InfluenzaA__ADD22825

SEQ ID NO: 170651 - RNA, 1410 nt, Artificial Sequence; identical to SEQ ID NO: 169258
  derived and/or modified sequence opt4 from neuraminidase__InfluenzaA__ADD22835

SEQ ID NO: 170652 - RNA, 1410 nt, Artificial Sequence; identical to SEQ ID NO: 169258
  derived and/or modified sequence opt4 from neuraminidase__InfluenzaA__ADD22845

SEQ ID NO: 170653 - RNA, 1410 nt, Artificial Sequence; identical to SEQ ID NO: 169258
  derived and/or modified sequence opt4 from neuraminidase__InfluenzaA__ADD22855

SEQ ID NO: 170654 - RNA, 1410 nt, Artificial Sequence; identical to SEQ ID NO: 169258
  derived and/or modified sequence opt4 from neuraminidase__InfluenzaA__ADD22924

SEQ ID NO: 170655 - RNA, 1410 nt, Artificial Sequence; identical to SEQ ID NO: 169258
  derived and/or modified sequence opt4 from neuraminidase__InfluenzaA__ADD22934

SEQ ID NO: 170656 - RNA, 1410 nt, Artificial Sequence; identical to SEQ ID NO: 169258
  derived and/or modified sequence opt4 from neuraminidase__InfluenzaA__ADD22944

SEQ ID NO: 170657 - RNA, 1410 nt, Artificial Sequence; identical to SEQ ID NO: 169258
  derived and/or modified sequence opt4 from neuraminidase__InfluenzaA__ADD22954

SEQ ID NO: 170658 - RNA, 1410 nt, Artificial Sequence; identical to SEQ ID NO: 169258
  derived and/or modified sequence opt4 from neuraminidase__InfluenzaA__ADD22974

SEQ ID NO: 170659 - RNA, 1410 nt, Artificial Sequence; identical to SEQ ID NO: 169258
  derived and/or modified sequence opt4 from neuraminidase__InfluenzaA__ADD23075

SEQ ID NO: 170660 - RNA, 1410 nt, Artificial Sequence
  derived and/or modified sequence opt4 from neuraminidase__InfluenzaA__ADD23085
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcuguucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170661 - RNA, 1410 nt, Artificial Sequence; identical to SEQ ID NO: 169258
  derived and/or modified sequence opt4 from neuraminidase__InfluenzaA__ADD23095

SEQ ID NO: 170662 - RNA, 1410 nt, Artificial Sequence; identical to SEQ ID NO: 169258
  derived and/or modified sequence opt4 from neuraminidase__InfluenzaA__ADD23105

SEQ ID NO: 170663 - RNA, 1410 nt, Artificial Sequence; identical to SEQ ID NO: 169258
  derived and/or modified sequence opt4 from neuraminidase__InfluenzaA__ADD23115

SEQ ID NO: 170664 - RNA, 1410 nt, Artificial Sequence; identical to SEQ ID NO: 169258
  derived and/or modified sequence opt4 from neuraminidase__InfluenzaA__ADD23125

SEQ ID NO: 170665 - RNA, 1410 nt, Artificial Sequence; identical to SEQ ID NO: 169258
  derived and/or modified sequence opt4 from neuraminidase__InfluenzaA__ADD23135

SEQ ID NO: 170666 - RNA, 1410 nt, Artificial Sequence; identical to SEQ ID NO: 169258
  derived and/or modified sequence opt4 from neuraminidase__InfluenzaA__ADD23145

SEQ ID NO: 170667 - RNA, 1410 nt, Artificial Sequence; identical to SEQ ID NO: 169258
  derived and/or modified sequence opt4 from neuraminidase__InfluenzaA__ADD23155

SEQ ID NO: 170668 - RNA, 1410 nt, Artificial Sequence; identical to SEQ ID NO: 169258
  derived and/or modified sequence opt4 from neuraminidase__InfluenzaA__ADD23165

SEQ ID NO: 170669 - RNA, 1410 nt, Artificial Sequence; identical to SEQ ID NO: 169258
  derived and/or modified sequence opt4 from neuraminidase__InfluenzaA__ADD23175

SEQ ID NO: 170670 - RNA, 1410 nt, Artificial Sequence; identical to SEQ ID NO: 169258
  derived and/or modified sequence opt4 from neuraminidase__InfluenzaA__ADD23185

SEQ ID NO: 170671 - RNA, 1410 nt, Artificial Sequence; identical to SEQ ID NO: 169258
  derived and/or modified sequence opt4 from neuraminidase__InfluenzaA__ADD23195

SEQ ID NO: 170672 - RNA, 1410 nt, Artificial Sequence; identical to SEQ ID NO: 169258
  derived and/or modified sequence opt4 from neuraminidase__InfluenzaA__ADD23223

SEQ ID NO: 170673 - RNA, 1410 nt, Artificial Sequence
  derived and/or modified sequence opt4 from neuraminidase__InfluenzaA__ADD23233
augaaccccaaccagaagaucaucaccaucggcagcgugugcaugaccaucggcauggccaaccugauccugcagaucggcaacaucaucagcaucuggaucggccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170674 - RNA, 1410 nt, Artificial Sequence; identical to SEQ ID NO: 169258
  derived and/or modified sequence opt4 from neuraminidase__InfluenzaA__ADD23243

SEQ ID NO: 170675 - RNA, 1410 nt, Artificial Sequence; identical to SEQ ID NO: 170546
  derived and/or modified sequence opt4 from neuraminidase__InfluenzaA__ADD23253

SEQ ID NO: 170676 - RNA, 1410 nt, Artificial Sequence
  derived and/or modified sequence opt4 from neuraminidase__InfluenzaA__ADD23273
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcgagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170677 - RNA, 1410 nt, Artificial Sequence; identical to SEQ ID NO: 169258
  derived and/or modified sequence opt4 from neuraminidase__InfluenzaA__ADD23283

SEQ ID NO: 170678 - RNA, 1410 nt, Artificial Sequence; identical to SEQ ID NO: 169258
  derived and/or modified sequence opt4 from neuraminidase__InfluenzaA__ADD23293

SEQ ID NO: 170679 - RNA, 1410 nt, Artificial Sequence; identical to SEQ ID NO: 169258
  derived and/or modified sequence opt4 from neuraminidase__InfluenzaA__ADD23303

SEQ ID NO: 170680 - RNA, 1410 nt, Artificial Sequence; identical to SEQ ID NO: 169258
  derived and/or modified sequence opt4 from neuraminidase__InfluenzaA__ADD23313

SEQ ID NO: 170681 - RNA, 1410 nt, Artificial Sequence
  derived and/or modified sequence opt4 from neuraminidase__InfluenzaA__ADD23323
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugcugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170682 - RNA, 1410 nt, Artificial Sequence; identical to SEQ ID NO: 169258
  derived and/or modified sequence opt4 from neuraminidase__InfluenzaA__ADD23333

SEQ ID NO: 170683 - RNA, 1410 nt, Artificial Sequence; identical to SEQ ID NO: 169258
  derived and/or modified sequence opt4 from neuraminidase__InfluenzaA__ADD23358

SEQ ID NO: 170684 - RNA, 1410 nt, Artificial Sequence; identical to SEQ ID NO: 170609
  derived and/or modified sequence opt4 from neuraminidase__InfluenzaA__ADD23368

SEQ ID NO: 170685 - RNA, 1410 nt, Artificial Sequence; identical to SEQ ID NO: 169258
  derived and/or modified sequence opt4 from neuraminidase__InfluenzaA__ADD23378

SEQ ID NO: 170686 - RNA, 1410 nt, Artificial Sequence; identical to SEQ ID NO: 169258
  derived and/or modified sequence opt4 from neuraminidase__InfluenzaA__ADD23388

SEQ ID NO: 170687 - RNA, 1410 nt, Artificial Sequence; identical to SEQ ID NO: 169841
  derived and/or modified sequence opt4 from neuraminidase__InfluenzaA__ADD23398

SEQ ID NO: 170688 - RNA, 1410 nt, Artificial Sequence
  derived and/or modified sequence opt4 from neuraminidase__InfluenzaA__ADD23408
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccaggaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170689 - RNA, 1410 nt, Artificial Sequence
  derived and/or modified sequence opt4 from neuraminidase__InfluenzaA__ADD23438
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170690 - RNA, 1410 nt, Artificial Sequence; identical to SEQ ID NO: 169258
  derived and/or modified sequence opt4 from neuraminidase__InfluenzaA__ADD23448

SEQ ID NO: 170691 - RNA, 1410 nt, Artificial Sequence; identical to SEQ ID NO: 169258
  derived and/or modified sequence opt4 from neuraminidase__InfluenzaA__ADD23458

SEQ ID NO: 170692 - RNA, 1410 nt, Artificial Sequence
  derived and/or modified sequence opt4 from neuraminidase__InfluenzaA__ADD23468
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcgugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170693 - RNA, 1410 nt, Artificial Sequence; identical to SEQ ID NO: 169258
  derived and/or modified sequence opt4 from neuraminidase__InfluenzaA__ADD23478

SEQ ID NO: 170694 - RNA, 1410 nt, Artificial Sequence; identical to SEQ ID NO: 169258
  derived and/or modified sequence opt4 from neuraminidase__InfluenzaA__ADD23488

SEQ ID NO: 170695 - RNA, 1410 nt, Artificial Sequence
  derived and/or modified sequence opt4 from neuraminidase__InfluenzaA__ADD23498
augaaccccaaccagaagaucaucaccaucggcagcgugugcaugaccaucggcauggccaaccugauccugcagaucggcaacaucaucagcaucuggaucagccacagcauccagcugggcaaccagaaccacaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170696 - RNA, 1410 nt, Artificial Sequence; identical to SEQ ID NO: 169258
  derived and/or modified sequence opt4 from neuraminidase__InfluenzaA__ADD23508

SEQ ID NO: 170697 - RNA, 1410 nt, Artificial Sequence; identical to SEQ ID NO: 169258
  derived and/or modified sequence opt4 from neuraminidase__InfluenzaA__ADD23518

SEQ ID NO: 170698 - RNA, 1410 nt, Artificial Sequence; identical to SEQ ID NO: 169258
  derived and/or modified sequence opt4 from neuraminidase__InfluenzaA__ADD23997

SEQ ID NO: 170699 - RNA, 1410 nt, Artificial Sequence; identical to SEQ ID NO: 169258
  derived and/or modified sequence opt4 from neuraminidase__InfluenzaA__ADD24007

SEQ ID NO: 170700 - RNA, 1410 nt, Artificial Sequence; identical to SEQ ID NO: 169258
  derived and/or modified sequence opt4 from neuraminidase__InfluenzaA__ADD24017

SEQ ID NO: 170701 - RNA, 1410 nt, Artificial Sequence; identical to SEQ ID NO: 169258
  derived and/or modified sequence opt4 from neuraminidase__InfluenzaA__ADD24024

SEQ ID NO: 170702 - RNA, 1410 nt, Artificial Sequence; identical to SEQ ID NO: 169258
  derived and/or modified sequence opt4 from neuraminidase__InfluenzaA__ADD24025

SEQ ID NO: 170703 - RNA, 1410 nt, Artificial Sequence; identical to SEQ ID NO: 169258
  derived and/or modified sequence opt4 from neuraminidase__InfluenzaA__ADD24026

SEQ ID NO: 170704 - RNA, 1410 nt, Artificial Sequence; identical to SEQ ID NO: 169258
  derived and/or modified sequence opt4 from neuraminidase__InfluenzaA__ADD24027

SEQ ID NO: 170705 - RNA, 1410 nt, Artificial Sequence; identical to SEQ ID NO: 169258
  derived and/or modified sequence opt4 from neuraminidase__InfluenzaA__ADD24028

SEQ ID NO: 170706 - RNA, 1410 nt, Artificial Sequence; identical to SEQ ID NO: 169258
  derived and/or modified sequence opt4 from neuraminidase__InfluenzaA__ADD24029

SEQ ID NO: 170707 - RNA, 1410 nt, Artificial Sequence; identical to SEQ ID NO: 169258
  derived and/or modified sequence opt4 from neuraminidase__InfluenzaA__ADD24030

SEQ ID NO: 170708 - RNA, 1410 nt, Artificial Sequence; identical to SEQ ID NO: 169258
  derived and/or modified sequence opt4 from neuraminidase__InfluenzaA__ADD24031

SEQ ID NO: 170709 - RNA, 1410 nt, Artificial Sequence; identical to SEQ ID NO: 169258
  derived and/or modified sequence opt4 from neuraminidase__InfluenzaA__ADD24032

SEQ ID NO: 170710 - RNA, 1410 nt, Artificial Sequence; identical to SEQ ID NO: 169258
  derived and/or modified sequence opt4 from neuraminidase__InfluenzaA__ADD25231

SEQ ID NO: 170711 - RNA, 1410 nt, Artificial Sequence; identical to SEQ ID NO: 169258
  derived and/or modified sequence opt4 from neuraminidase__InfluenzaA__ADD25233

SEQ ID NO: 170712 - RNA, 1410 nt, Artificial Sequence; identical to SEQ ID NO: 169258
  derived and/or modified sequence opt4 from neuraminidase__InfluenzaA__ADD25235

SEQ ID NO: 170713 - RNA, 1410 nt, Artificial Sequence; identical to SEQ ID NO: 169258
  derived and/or modified sequence opt4 from neuraminidase__InfluenzaA__ADD25244

SEQ ID NO: 170714 - RNA, 1410 nt, Artificial Sequence
  derived and/or modified sequence opt4 from neuraminidase__InfluenzaA__ADD25246
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaccaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170715 - RNA, 1410 nt, Artificial Sequence; identical to SEQ ID NO: 169258
  derived and/or modified sequence opt4 from neuraminidase__InfluenzaA__ADD25248

SEQ ID NO: 170716 - RNA, 1410 nt, Artificial Sequence
  derived and/or modified sequence opt4 from neuraminidase__InfluenzaA__ADD25250
augaaccccaaccagaagaucaucaccaucggcagcgugugcaugaccaucggcauggccaaccugauccugcagaucggcaacaucaucagcaucuggaucagcagaagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcggcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccaugggcuggagcuggcccgacggcgccgagcugcccuucaccaucgacaaguga

SEQ ID NO: 170717 - RNA, 1410 nt, Artificial Sequence; identical to SEQ ID NO: 169258
  derived and/or modified sequence opt4 from neuraminidase__InfluenzaA__ADD25255

SEQ ID NO: 170718 - RNA, 1410 nt, Artificial Sequence; identical to SEQ ID NO: 169258
  derived and/or modified sequence opt4 from neuraminidase__InfluenzaA__ADD25259

SEQ ID NO: 170719 - RNA, 1410 nt, Artificial Sequence
  derived and/or modified sequence opt4 from neuraminidase__InfluenzaA__ADD25262
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccgacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170720 - RNA, 1410 nt, Artificial Sequence
  derived and/or modified sequence opt4 from neuraminidase__InfluenzaA__ADD25266
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170721 - RNA, 1410 nt, Artificial Sequence; identical to SEQ ID NO: 169258
  derived and/or modified sequence opt4 from neuraminidase__InfluenzaA__ADD25268

SEQ ID NO: 170722 - RNA, 1410 nt, Artificial Sequence; identical to SEQ ID NO: 169258
  derived and/or modified sequence opt4 from neuraminidase__InfluenzaA__ADD25271

SEQ ID NO: 170723 - RNA, 1410 nt, Artificial Sequence; identical to SEQ ID NO: 169258
  derived and/or modified sequence opt4 from neuraminidase__InfluenzaA__ADD25274

SEQ ID NO: 170724 - RNA, 1410 nt, Artificial Sequence; identical to SEQ ID NO: 169258
  derived and/or modified sequence opt4 from neuraminidase__InfluenzaA__ADD25276

SEQ ID NO: 170725 - RNA, 1410 nt, Artificial Sequence
  derived and/or modified sequence opt4 from neuraminidase__InfluenzaA__ADD25278
augaaccccaaccagaagaucaucaccaucggcagcgugugcaugaccaucggcauggccaaccugauccugcagaucggcaacaucaucagcaucuggaucagcagaagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcggcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170726 - RNA, 1410 nt, Artificial Sequence; identical to SEQ ID NO: 169258
  derived and/or modified sequence opt4 from neuraminidase__InfluenzaA__ADD25280

SEQ ID NO: 170727 - RNA, 1410 nt, Artificial Sequence; identical to SEQ ID NO: 169258
  derived and/or modified sequence opt4 from neuraminidase__InfluenzaA__ADD25282

SEQ ID NO: 170728 - RNA, 1410 nt, Artificial Sequence; identical to SEQ ID NO: 170546
  derived and/or modified sequence opt4 from neuraminidase__InfluenzaA__ADD25284

SEQ ID NO: 170729 - RNA, 1410 nt, Artificial Sequence; identical to SEQ ID NO: 169258
  derived and/or modified sequence opt4 from neuraminidase__InfluenzaA__ADD25287

SEQ ID NO: 170730 - RNA, 1410 nt, Artificial Sequence; identical to SEQ ID NO: 169258
  derived and/or modified sequence opt4 from neuraminidase__InfluenzaA__ADD25291

SEQ ID NO: 170731 - RNA, 1410 nt, Artificial Sequence; identical to SEQ ID NO: 170546
  derived and/or modified sequence opt4 from neuraminidase__InfluenzaA__ADD25293

SEQ ID NO: 170732 - RNA, 1410 nt, Artificial Sequence; identical to SEQ ID NO: 169258
  derived and/or modified sequence opt4 from neuraminidase__InfluenzaA__ADD25300

SEQ ID NO: 170733 - RNA, 1410 nt, Artificial Sequence
  derived and/or modified sequence opt4 from neuraminidase__InfluenzaA__ADD25304
augaaccccaaccagaagaucaucaccaucggcagcgugugcaugaccaucggcauggccaaccugauccugcagaucggcaacaucgugagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170734 - RNA, 1410 nt, Artificial Sequence
  derived and/or modified sequence opt4 from neuraminidase__InfluenzaA__ADD25306
augaaccccaaccagaagaucaucaccaucggcagcgugugcaugaccaucggcauggccaaccugauccugcagaucggcaacaucaucagcaucuggaucagcagaagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacgagcccagcgacggccaggccagcuacaagaucuucagaaucgagaagggcaagaucgugaagagcguggagaugaacgcccccaacuaccacuacgaggagugcagcugcuaccccgacagcggcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170735 - RNA, 1410 nt, Artificial Sequence; identical to SEQ ID NO: 169258
  derived and/or modified sequence opt4 from neuraminidase__InfluenzaA__ADD25308

SEQ ID NO: 170736 - RNA, 1410 nt, Artificial Sequence; identical to SEQ ID NO: 169258
  derived and/or modified sequence opt4 from neuraminidase__InfluenzaA__ADD25310

SEQ ID NO: 170737 - RNA, 1410 nt, Artificial Sequence; identical to SEQ ID NO: 169258
  derived and/or modified sequence opt4 from neuraminidase__InfluenzaA__ADD25312

SEQ ID NO: 170738 - RNA, 1410 nt, Artificial Sequence; identical to SEQ ID NO: 169258
  derived and/or modified sequence opt4 from neuraminidase__InfluenzaA__ADD25314

SEQ ID NO: 170739 - RNA, 1410 nt, Artificial Sequence; identical to SEQ ID NO: 169258
  derived and/or modified sequence opt4 from neuraminidase__InfluenzaA__ADD25316

SEQ ID NO: 170740 - RNA, 1410 nt, Artificial Sequence; identical to SEQ ID NO: 169258
  derived and/or modified sequence opt4 from neuraminidase__InfluenzaA__ADD29799

SEQ ID NO: 170741 - RNA, 1410 nt, Artificial Sequence; identical to SEQ ID NO: 169258
  derived and/or modified sequence opt4 from neuraminidase__InfluenzaA__ADD29800

SEQ ID NO: 170742 - RNA, 1410 nt, Artificial Sequence; identical to SEQ ID NO: 169258
  derived and/or modified sequence opt4 from neuraminidase__InfluenzaA__ADD29801

SEQ ID NO: 170743 - RNA, 1410 nt, Artificial Sequence; identical to SEQ ID NO: 169258
  derived and/or modified sequence opt4 from neuraminidase__InfluenzaA__ADD29802

SEQ ID NO: 170744 - RNA, 1410 nt, Artificial Sequence; identical to SEQ ID NO: 169258
  derived and/or modified sequence opt4 from neuraminidase__InfluenzaA__ADD29803

SEQ ID NO: 170745 - RNA, 1410 nt, Artificial Sequence; identical to SEQ ID NO: 169258
  derived and/or modified sequence opt4 from neuraminidase__InfluenzaA__ADD29804

SEQ ID NO: 170746 - RNA, 1410 nt, Artificial Sequence; identical to SEQ ID NO: 169258
  derived and/or modified sequence opt4 from neuraminidase__InfluenzaA__ADD29805

SEQ ID NO: 170747 - RNA, 1410 nt, Artificial Sequence; identical to SEQ ID NO: 169258
  derived and/or modified sequence opt4 from neuraminidase__InfluenzaA__ADD29806

SEQ ID NO: 170748 - RNA, 1410 nt, Artificial Sequence; identical to SEQ ID NO: 169258
  derived and/or modified sequence opt4 from neuraminidase__InfluenzaA__ADD29807

SEQ ID NO: 170749 - RNA, 1410 nt, Artificial Sequence; identical to SEQ ID NO: 169258
  derived and/or modified sequence opt4 from neuraminidase__InfluenzaA__ADD29808

SEQ ID NO: 170750 - RNA, 1410 nt, Artificial Sequence; identical to SEQ ID NO: 169258
  derived and/or modified sequence opt4 from neuraminidase__InfluenzaA__ADD52538

SEQ ID NO: 170751 - RNA, 1410 nt, Artificial Sequence; identical to SEQ ID NO: 170481
  derived and/or modified sequence opt4 from neuraminidase__InfluenzaA__ADD74353

SEQ ID NO: 170752 - RNA, 1410 nt, Artificial Sequence; identical to SEQ ID NO: 169258
  derived and/or modified sequence opt4 from neuraminidase__InfluenzaA__ADD74373

SEQ ID NO: 170753 - RNA, 1410 nt, Artificial Sequence; identical to SEQ ID NO: 169258
  derived and/or modified sequence opt4 from neuraminidase__InfluenzaA__ADD74383

SEQ ID NO: 170754 - RNA, 1410 nt, Artificial Sequence; identical to SEQ ID NO: 169258
  derived and/or modified sequence opt4 from neuraminidase__InfluenzaA__ADD74401

SEQ ID NO: 170755 - RNA, 1410 nt, Artificial Sequence
  derived and/or modified sequence opt4 from neuraminidase__InfluenzaA__ADD74411
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacguggccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcagcggcguguggaucggcagaaccaagagcaucagcagcagaagcggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170756 - RNA, 1410 nt, Artificial Sequence; identical to SEQ ID NO: 169258
  derived and/or modified sequence opt4 from neuraminidase__InfluenzaA__ADD74421

SEQ ID NO: 170757 - RNA, 1410 nt, Artificial Sequence; identical to SEQ ID NO: 169258
  derived and/or modified sequence opt4 from neuraminidase__InfluenzaA__ADD74431

SEQ ID NO: 170758 - RNA, 1410 nt, Artificial Sequence
  derived and/or modified sequence opt4 from neuraminidase__InfluenzaA__ADD74441
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaucuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170759 - RNA, 1410 nt, Artificial Sequence; identical to SEQ ID NO: 169258
  derived and/or modified sequence opt4 from neuraminidase__InfluenzaA__ADD74451

SEQ ID NO: 170760 - RNA, 1410 nt, Artificial Sequence; identical to SEQ ID NO: 169258
  derived and/or modified sequence opt4 from neuraminidase__InfluenzaA__ADD74461

SEQ ID NO: 170761 - RNA, 1410 nt, Artificial Sequence; identical to SEQ ID NO: 169258
  derived and/or modified sequence opt4 from neuraminidase__InfluenzaA__ADD74471

SEQ ID NO: 170762 - RNA, 1410 nt, Artificial Sequence; identical to SEQ ID NO: 169258
  derived and/or modified sequence opt4 from neuraminidase__InfluenzaA__ADD74481

SEQ ID NO: 170763 - RNA, 1410 nt, Artificial Sequence; identical to SEQ ID NO: 170275
  derived and/or modified sequence opt4 from neuraminidase__InfluenzaA__ADD74491

SEQ ID NO: 170764 - RNA, 1410 nt, Artificial Sequence; identical to SEQ ID NO: 169258
  derived and/or modified sequence opt4 from neuraminidase__InfluenzaA__ADD74501

SEQ ID NO: 170765 - RNA, 1410 nt, Artificial Sequence; identical to SEQ ID NO: 169258
  derived and/or modified sequence opt4 from neuraminidase__InfluenzaA__ADD74511

SEQ ID NO: 170766 - RNA, 1410 nt, Artificial Sequence; identical to SEQ ID NO: 170276
  derived and/or modified sequence opt4 from neuraminidase__InfluenzaA__ADD74521

SEQ ID NO: 170767 - RNA, 1410 nt, Artificial Sequence; identical to SEQ ID NO: 169258
  derived and/or modified sequence opt4 from neuraminidase__InfluenzaA__ADD74531

SEQ ID NO: 170768 - RNA, 1410 nt, Artificial Sequence
  derived and/or modified sequence opt4 from neuraminidase__InfluenzaA__ADD74551
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacuacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170769 - RNA, 1410 nt, Artificial Sequence; identical to SEQ ID NO: 169258
  derived and/or modified sequence opt4 from neuraminidase__InfluenzaA__ADD74561

SEQ ID NO: 170770 - RNA, 1410 nt, Artificial Sequence; identical to SEQ ID NO: 169258
  derived and/or modified sequence opt4 from neuraminidase__InfluenzaA__ADD74571

SEQ ID NO: 170771 - RNA, 1410 nt, Artificial Sequence
  derived and/or modified sequence opt4 from neuraminidase__InfluenzaA__ADD74581
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacgccgugggcuggagcuggcccgacggcgccgagcugcccuucaccaucgacaaguga

SEQ ID NO: 170772 - RNA, 1410 nt, Artificial Sequence; identical to SEQ ID NO: 169258
  derived and/or modified sequence opt4 from neuraminidase__InfluenzaA__ADD74591

SEQ ID NO: 170773 - RNA, 1410 nt, Artificial Sequence; identical to SEQ ID NO: 169258
  derived and/or modified sequence opt4 from neuraminidase__InfluenzaA__ADD74601

SEQ ID NO: 170774 - RNA, 1410 nt, Artificial Sequence
  derived and/or modified sequence opt4 from neuraminidase__InfluenzaA__ADD74611
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcaucaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170775 - RNA, 1410 nt, Artificial Sequence; identical to SEQ ID NO: 169258
  derived and/or modified sequence opt4 from neuraminidase__InfluenzaA__ADD74621

SEQ ID NO: 170776 - RNA, 1410 nt, Artificial Sequence; identical to SEQ ID NO: 169258
  derived and/or modified sequence opt4 from neuraminidase__InfluenzaA__ADD74631

SEQ ID NO: 170777 - RNA, 1410 nt, Artificial Sequence; identical to SEQ ID NO: 169258
  derived and/or modified sequence opt4 from neuraminidase__InfluenzaA__ADD74641

SEQ ID NO: 170778 - RNA, 1410 nt, Artificial Sequence; identical to SEQ ID NO: 169258
  derived and/or modified sequence opt4 from neuraminidase__InfluenzaA__ADD74651

SEQ ID NO: 170779 - RNA, 1410 nt, Artificial Sequence; identical to SEQ ID NO: 170609
  derived and/or modified sequence opt4 from neuraminidase__InfluenzaA__ADD74661

SEQ ID NO: 170780 - RNA, 1410 nt, Artificial Sequence; identical to SEQ ID NO: 169258
  derived and/or modified sequence opt4 from neuraminidase__InfluenzaA__ADD74671

SEQ ID NO: 170781 - RNA, 1410 nt, Artificial Sequence; identical to SEQ ID NO: 169258
  derived and/or modified sequence opt4 from neuraminidase__InfluenzaA__ADD74681

SEQ ID NO: 170782 - RNA, 1410 nt, Artificial Sequence
  derived and/or modified sequence opt4 from neuraminidase__InfluenzaA__ADD74691
augaaccccaaccagaagaucaucaccaucggcagcgugugcaugaccaucggcauggccaaccugauccugcagaucggcaacaucaucagcaucuggaucugccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170783 - RNA, 1410 nt, Artificial Sequence; identical to SEQ ID NO: 169258
  derived and/or modified sequence opt4 from neuraminidase__InfluenzaA__ADD74701

SEQ ID NO: 170784 - RNA, 1410 nt, Artificial Sequence; identical to SEQ ID NO: 169258
  derived and/or modified sequence opt4 from neuraminidase__InfluenzaA__ADD74711

SEQ ID NO: 170785 - RNA, 1410 nt, Artificial Sequence; identical to SEQ ID NO: 169258
  derived and/or modified sequence opt4 from neuraminidase__InfluenzaA__ADD74721

SEQ ID NO: 170786 - RNA, 1410 nt, Artificial Sequence; identical to SEQ ID NO: 169258
  derived and/or modified sequence opt4 from neuraminidase__InfluenzaA__ADD74731

SEQ ID NO: 170787 - RNA, 1410 nt, Artificial Sequence
  derived and/or modified sequence opt4 from neuraminidase__InfluenzaA__ADD74741
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcagcagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170788 - RNA, 1410 nt, Artificial Sequence
  derived and/or modified sequence opt4 from neuraminidase__InfluenzaA__ADD74751
augaaccccaaccagaagaucaucaccaucggcagcgugugcaugaccaucggcauggccaaccugauccugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccugaaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170789 - RNA, 1410 nt, Artificial Sequence
  derived and/or modified sequence opt4 from neuraminidase__InfluenzaA__ADD74761
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcaucaacagcgacaccgugggcuggagcuggcccgacggcgccgagcugcccuucaccaucgacaaguga

SEQ ID NO: 170790 - RNA, 1410 nt, Artificial Sequence; identical to SEQ ID NO: 169258
  derived and/or modified sequence opt4 from neuraminidase__InfluenzaA__ADD74791

SEQ ID NO: 170791 - RNA, 1410 nt, Artificial Sequence; identical to SEQ ID NO: 169841
  derived and/or modified sequence opt4 from neuraminidase__InfluenzaA__ADD74811

SEQ ID NO: 170792 - RNA, 1410 nt, Artificial Sequence; identical to SEQ ID NO: 169258
  derived and/or modified sequence opt4 from neuraminidase__InfluenzaA__ADD74821

SEQ ID NO: 170793 - RNA, 1410 nt, Artificial Sequence
  derived and/or modified sequence opt4 from neuraminidase__InfluenzaA__ADD74831
augaaccccaaccagaagaucaucaccaucggcagcaucugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugccugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170794 - RNA, 1410 nt, Artificial Sequence; identical to SEQ ID NO: 169258
  derived and/or modified sequence opt4 from neuraminidase__InfluenzaA__ADD74841

SEQ ID NO: 170795 - RNA, 1410 nt, Artificial Sequence; identical to SEQ ID NO: 169258
  derived and/or modified sequence opt4 from neuraminidase__InfluenzaA__ADD74851

SEQ ID NO: 170796 - RNA, 1410 nt, Artificial Sequence; identical to SEQ ID NO: 170365
  derived and/or modified sequence opt4 from neuraminidase__InfluenzaA__ADD74861

SEQ ID NO: 170797 - RNA, 1410 nt, Artificial Sequence; identical to SEQ ID NO: 169258
  derived and/or modified sequence opt4 from neuraminidase__InfluenzaA__ADD74871

SEQ ID NO: 170798 - RNA, 1410 nt, Artificial Sequence; identical to SEQ ID NO: 169258
  derived and/or modified sequence opt4 from neuraminidase__InfluenzaA__ADD74881

SEQ ID NO: 170799 - RNA, 1410 nt, Artificial Sequence; identical to SEQ ID NO: 169258
  derived and/or modified sequence opt4 from neuraminidase__InfluenzaA__ADD74891

SEQ ID NO: 170800 - RNA, 1410 nt, Artificial Sequence; identical to SEQ ID NO: 169258
  derived and/or modified sequence opt4 from neuraminidase__InfluenzaA__ADD74901

SEQ ID NO: 170801 - RNA, 1410 nt, Artificial Sequence; identical to SEQ ID NO: 169258
  derived and/or modified sequence opt4 from neuraminidase__InfluenzaA__ADD74911

SEQ ID NO: 170802 - RNA, 1410 nt, Artificial Sequence; identical to SEQ ID NO: 169258
  derived and/or modified sequence opt4 from neuraminidase__InfluenzaA__ADD74921

SEQ ID NO: 170803 - RNA, 1410 nt, Artificial Sequence; identical to SEQ ID NO: 169258
  derived and/or modified sequence opt4 from neuraminidase__InfluenzaA__ADD74941

SEQ ID NO: 170804 - RNA, 1410 nt, Artificial Sequence
  derived and/or modified sequence opt4 from neuraminidase__InfluenzaA__ADD74961
augaaccccaaccagaagaucaucaccaucggcagcgugugcaugaccaucggcauggccaaccugauccugcagaucggcaacaucaucagcaucuggaucagccacagcauccagcugggcaaccagaaccagaucggcaccugcaaccagagcgugaucaccuacgagaacaacaccugggugaaccacaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170805 - RNA, 1410 nt, Artificial Sequence; identical to SEQ ID NO: 169258
  derived and/or modified sequence opt4 from neuraminidase__InfluenzaA__ADD74971

SEQ ID NO: 170806 - RNA, 1410 nt, Artificial Sequence
  derived and/or modified sequence opt4 from neuraminidase__InfluenzaA__ADD74981
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaagcggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 170807 - RNA, 1410 nt, Artificial Sequence; identical to SEQ ID NO: 169258
  derived and/or modified sequence opt4 from neuraminidase__InfluenzaA__ADD74991

SEQ ID NO: 170808 - RNA, 1410 nt, Artificial Sequence; identical to SEQ ID NO: 169258
  derived and/or modified sequence opt4 from neuraminidase__InfluenzaA__ADD75001

SEQ ID NO: 170809 - RNA, 1410 nt, Artificial Sequence
  derived and/or modified sequence opt4 from neuraminidase__InfluenzaA__ADD75011
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcgaccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170810 - RNA, 1410 nt, Artificial Sequence; identical to SEQ ID NO: 170546
  derived and/or modified sequence opt4 from neuraminidase__InfluenzaA__ADD75031

SEQ ID NO: 170811 - RNA, 1410 nt, Artificial Sequence
  derived and/or modified sequence opt4 from neuraminidase__InfluenzaA__ADD75041
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaagaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170812 - RNA, 1410 nt, Artificial Sequence; identical to SEQ ID NO: 169258
  derived and/or modified sequence opt4 from neuraminidase__InfluenzaA__ADD75051

SEQ ID NO: 170813 - RNA, 1410 nt, Artificial Sequence; identical to SEQ ID NO: 169258
  derived and/or modified sequence opt4 from neuraminidase__InfluenzaA__ADD75061

SEQ ID NO: 170814 - RNA, 1410 nt, Artificial Sequence; identical to SEQ ID NO: 169258
  derived and/or modified sequence opt4 from neuraminidase__InfluenzaA__ADD75071

SEQ ID NO: 170815 - RNA, 1410 nt, Artificial Sequence; identical to SEQ ID NO: 169258
  derived and/or modified sequence opt4 from neuraminidase__InfluenzaA__ADD75081

SEQ ID NO: 170816 - RNA, 1410 nt, Artificial Sequence
  derived and/or modified sequence opt4 from neuraminidase__InfluenzaA__ADD75091
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaagcggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170817 - RNA, 1410 nt, Artificial Sequence; identical to SEQ ID NO: 169258
  derived and/or modified sequence opt4 from neuraminidase__InfluenzaA__ADD75101

SEQ ID NO: 170818 - RNA, 1410 nt, Artificial Sequence; identical to SEQ ID NO: 169258
  derived and/or modified sequence opt4 from neuraminidase__InfluenzaA__ADD75111

SEQ ID NO: 170819 - RNA, 1410 nt, Artificial Sequence; identical to SEQ ID NO: 169258
  derived and/or modified sequence opt4 from neuraminidase__InfluenzaA__ADD75121

SEQ ID NO: 170820 - RNA, 1410 nt, Artificial Sequence; identical to SEQ ID NO: 169258
  derived and/or modified sequence opt4 from neuraminidase__InfluenzaA__ADD75131

SEQ ID NO: 170821 - RNA, 1410 nt, Artificial Sequence; identical to SEQ ID NO: 169258
  derived and/or modified sequence opt4 from neuraminidase__InfluenzaA__ADD75141

SEQ ID NO: 170822 - RNA, 1410 nt, Artificial Sequence
  derived and/or modified sequence opt4 from neuraminidase__InfluenzaA__ADD75161
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcagcuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacaagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacagauga

SEQ ID NO: 170823 - RNA, 1410 nt, Artificial Sequence
  derived and/or modified sequence opt4 from neuraminidase__InfluenzaA__ADD84500
augaaccccaaccagaacaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaucgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170824 - RNA, 1410 nt, Artificial Sequence
  derived and/or modified sequence opt4 from neuraminidase__InfluenzaA__ADD84502
augaaccccaaccagaacaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170825 - RNA, 1410 nt, Artificial Sequence; identical to SEQ ID NO: 170824
  derived and/or modified sequence opt4 from neuraminidase__InfluenzaA__ADD84503

SEQ ID NO: 170826 - RNA, 1410 nt, Artificial Sequence
  derived and/or modified sequence opt4 from neuraminidase__InfluenzaA__ADD84504
augaaccccaaccagaacaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacuucagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170827 - RNA, 1410 nt, Artificial Sequence; identical to SEQ ID NO: 170824
  derived and/or modified sequence opt4 from neuraminidase__InfluenzaA__ADD84505

SEQ ID NO: 170828 - RNA, 1410 nt, Artificial Sequence; identical to SEQ ID NO: 170824
  derived and/or modified sequence opt4 from neuraminidase__InfluenzaA__ADD84506

SEQ ID NO: 170829 - RNA, 1410 nt, Artificial Sequence
  derived and/or modified sequence opt4 from neuraminidase__InfluenzaA__ADD92528
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggccacagcggcagcagcgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170830 - RNA, 1410 nt, Artificial Sequence; identical to SEQ ID NO: 170481
  derived and/or modified sequence opt4 from neuraminidase__InfluenzaA__ADD96769

SEQ ID NO: 170831 - RNA, 1410 nt, Artificial Sequence; identical to SEQ ID NO: 170481
  derived and/or modified sequence opt4 from neuraminidase__InfluenzaA__ADD96779

SEQ ID NO: 170832 - RNA, 1410 nt, Artificial Sequence; identical to SEQ ID NO: 170481
  derived and/or modified sequence opt4 from neuraminidase__InfluenzaA__ADD96789

SEQ ID NO: 170833 - RNA, 1410 nt, Artificial Sequence; identical to SEQ ID NO: 170609
  derived and/or modified sequence opt4 from neuraminidase__InfluenzaA__ADD96799

SEQ ID NO: 170834 - RNA, 1410 nt, Artificial Sequence; identical to SEQ ID NO: 169258
  derived and/or modified sequence opt4 from neuraminidase__InfluenzaA__ADD96809

SEQ ID NO: 170835 - RNA, 1410 nt, Artificial Sequence
  derived and/or modified sequence opt4 from neuraminidase__InfluenzaA__ADD96819
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcagcagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170836 - RNA, 1410 nt, Artificial Sequence; identical to SEQ ID NO: 169258
  derived and/or modified sequence opt4 from neuraminidase__InfluenzaA__ADD96829

SEQ ID NO: 170837 - RNA, 1410 nt, Artificial Sequence; identical to SEQ ID NO: 169258
  derived and/or modified sequence opt4 from neuraminidase__InfluenzaA__ADD96839

SEQ ID NO: 170838 - RNA, 1410 nt, Artificial Sequence; identical to SEQ ID NO: 169258
  derived and/or modified sequence opt4 from neuraminidase__InfluenzaA__ADD96849

SEQ ID NO: 170839 - RNA, 1410 nt, Artificial Sequence; identical to SEQ ID NO: 169258
  derived and/or modified sequence opt4 from neuraminidase__InfluenzaA__ADD96859

SEQ ID NO: 170840 - RNA, 1410 nt, Artificial Sequence
  derived and/or modified sequence opt4 from neuraminidase__InfluenzaA__ADD96869
augaaccccaaccagaagaucaucaccaucggcagcgugugcaugaccaucggcauggccaaccugauccugcagaucggcaacaucaucagcaucuggaucagccaccccauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggaagaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170841 - RNA, 1410 nt, Artificial Sequence
  derived and/or modified sequence opt4 from neuraminidase__InfluenzaA__ADD96879
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccugggcugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170842 - RNA, 1410 nt, Artificial Sequence; identical to SEQ ID NO: 169258
  derived and/or modified sequence opt4 from neuraminidase__InfluenzaA__ADD96889

SEQ ID NO: 170843 - RNA, 1410 nt, Artificial Sequence; identical to SEQ ID NO: 169841
  derived and/or modified sequence opt4 from neuraminidase__InfluenzaA__ADD96899

SEQ ID NO: 170844 - RNA, 1410 nt, Artificial Sequence; identical to SEQ ID NO: 169258
  derived and/or modified sequence opt4 from neuraminidase__InfluenzaA__ADD96909

SEQ ID NO: 170845 - RNA, 1410 nt, Artificial Sequence; identical to SEQ ID NO: 169258
  derived and/or modified sequence opt4 from neuraminidase__InfluenzaA__ADD96919

SEQ ID NO: 170846 - RNA, 1410 nt, Artificial Sequence; identical to SEQ ID NO: 169258
  derived and/or modified sequence opt4 from neuraminidase__InfluenzaA__ADD96929

SEQ ID NO: 170847 - RNA, 1410 nt, Artificial Sequence; identical to SEQ ID NO: 169258
  derived and/or modified sequence opt4 from neuraminidase__InfluenzaA__ADD96939

SEQ ID NO: 170848 - RNA, 1410 nt, Artificial Sequence; identical to SEQ ID NO: 169258
  derived and/or modified sequence opt4 from neuraminidase__InfluenzaA__ADD96959

SEQ ID NO: 170849 - RNA, 1410 nt, Artificial Sequence; identical to SEQ ID NO: 169258
  derived and/or modified sequence opt4 from neuraminidase__InfluenzaA__ADD96969

SEQ ID NO: 170850 - RNA, 1410 nt, Artificial Sequence
  derived and/or modified sequence opt4 from neuraminidase__InfluenzaA__ADD96989
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcagcuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170851 - RNA, 1410 nt, Artificial Sequence
  derived and/or modified sequence opt4 from neuraminidase__InfluenzaA__ADD97038
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaucggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccggcggcuggagcuggcccgacggcgccgagcugcccuucaccaucgacaaguga

SEQ ID NO: 170852 - RNA, 1410 nt, Artificial Sequence; identical to SEQ ID NO: 169258
  derived and/or modified sequence opt4 from neuraminidase__InfluenzaA__ADD97048

SEQ ID NO: 170853 - RNA, 1410 nt, Artificial Sequence; identical to SEQ ID NO: 169258
  derived and/or modified sequence opt4 from neuraminidase__InfluenzaA__ADD97058

SEQ ID NO: 170854 - RNA, 1410 nt, Artificial Sequence; identical to SEQ ID NO: 169258
  derived and/or modified sequence opt4 from neuraminidase__InfluenzaA__ADD97069

SEQ ID NO: 170855 - RNA, 1410 nt, Artificial Sequence; identical to SEQ ID NO: 169258
  derived and/or modified sequence opt4 from neuraminidase__InfluenzaA__ADD97126

SEQ ID NO: 170856 - RNA, 1410 nt, Artificial Sequence; identical to SEQ ID NO: 169258
  derived and/or modified sequence opt4 from neuraminidase__InfluenzaA__ADD97164

SEQ ID NO: 170857 - RNA, 1410 nt, Artificial Sequence; identical to SEQ ID NO: 169258
  derived and/or modified sequence opt4 from neuraminidase__InfluenzaA__ADD97174

SEQ ID NO: 170858 - RNA, 1410 nt, Artificial Sequence; identical to SEQ ID NO: 169258
  derived and/or modified sequence opt4 from neuraminidase__InfluenzaA__ADD97184

SEQ ID NO: 170859 - RNA, 1410 nt, Artificial Sequence
  derived and/or modified sequence opt4 from neuraminidase__InfluenzaA__ADD97194
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacgccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170860 - RNA, 1410 nt, Artificial Sequence; identical to SEQ ID NO: 170850
  derived and/or modified sequence opt4 from neuraminidase__InfluenzaA__ADD97204

SEQ ID NO: 170861 - RNA, 1410 nt, Artificial Sequence; identical to SEQ ID NO: 169258
  derived and/or modified sequence opt4 from neuraminidase__InfluenzaA__ADD97214

SEQ ID NO: 170862 - RNA, 1410 nt, Artificial Sequence; identical to SEQ ID NO: 169258
  derived and/or modified sequence opt4 from neuraminidase__InfluenzaA__ADD97224

SEQ ID NO: 170863 - RNA, 1410 nt, Artificial Sequence; identical to SEQ ID NO: 169258
  derived and/or modified sequence opt4 from neuraminidase__InfluenzaA__ADD97234

SEQ ID NO: 170864 - RNA, 1410 nt, Artificial Sequence; identical to SEQ ID NO: 169258
  derived and/or modified sequence opt4 from neuraminidase__InfluenzaA__ADD97244

SEQ ID NO: 170865 - RNA, 1410 nt, Artificial Sequence; identical to SEQ ID NO: 169258
  derived and/or modified sequence opt4 from neuraminidase__InfluenzaA__ADD97254

SEQ ID NO: 170866 - RNA, 1410 nt, Artificial Sequence; identical to SEQ ID NO: 169258
  derived and/or modified sequence opt4 from neuraminidase__InfluenzaA__ADD97264

SEQ ID NO: 170867 - RNA, 1410 nt, Artificial Sequence; identical to SEQ ID NO: 169258
  derived and/or modified sequence opt4 from neuraminidase__InfluenzaA__ADD97274

SEQ ID NO: 170868 - RNA, 1410 nt, Artificial Sequence
  derived and/or modified sequence opt4 from neuraminidase__InfluenzaA__ADD97284
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucugcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170869 - RNA, 1410 nt, Artificial Sequence; identical to SEQ ID NO: 169258
  derived and/or modified sequence opt4 from neuraminidase__InfluenzaA__ADD97294

SEQ ID NO: 170870 - RNA, 1410 nt, Artificial Sequence
  derived and/or modified sequence opt4 from neuraminidase__InfluenzaA__ADD97314
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170871 - RNA, 1410 nt, Artificial Sequence; identical to SEQ ID NO: 169258
  derived and/or modified sequence opt4 from neuraminidase__InfluenzaA__ADD97334

SEQ ID NO: 170872 - RNA, 1410 nt, Artificial Sequence; identical to SEQ ID NO: 169258
  derived and/or modified sequence opt4 from neuraminidase__InfluenzaA__ADD97344

SEQ ID NO: 170873 - RNA, 1410 nt, Artificial Sequence; identical to SEQ ID NO: 169258
  derived and/or modified sequence opt4 from neuraminidase__InfluenzaA__ADD97354

SEQ ID NO: 170874 - RNA, 1410 nt, Artificial Sequence
  derived and/or modified sequence opt4 from neuraminidase__InfluenzaA__ADD97384
augaaccccaaccagaagaucaucaccaucggcagcgugugcaugaccaucggcauggccaaccugauccugcagaucggcaacaucaucagcaucuggaucagccacaccauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170875 - RNA, 1410 nt, Artificial Sequence
  derived and/or modified sequence opt4 from neuraminidase__InfluenzaA__ADD97394
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagcccguggugagcgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170876 - RNA, 1410 nt, Artificial Sequence; identical to SEQ ID NO: 169258
  derived and/or modified sequence opt4 from neuraminidase__InfluenzaA__ADD97404

SEQ ID NO: 170877 - RNA, 1410 nt, Artificial Sequence; identical to SEQ ID NO: 169258
  derived and/or modified sequence opt4 from neuraminidase__InfluenzaA__ADD97424

SEQ ID NO: 170878 - RNA, 1410 nt, Artificial Sequence; identical to SEQ ID NO: 169258
  derived and/or modified sequence opt4 from neuraminidase__InfluenzaA__ADD97434

SEQ ID NO: 170879 - RNA, 1410 nt, Artificial Sequence; identical to SEQ ID NO: 169258
  derived and/or modified sequence opt4 from neuraminidase__InfluenzaA__ADD97444

SEQ ID NO: 170880 - RNA, 1410 nt, Artificial Sequence
  derived and/or modified sequence opt4 from neuraminidase__InfluenzaA__ADD97454
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccaucagcggcugggccaucuacagcaaggacaacagcaucagaaucggcagcaagggcgacguguucgugaucagagagcccuucaucagcugcagcccccuggagugcagaaccuucuuccugacccagggcgcccugcugagcgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170881 - RNA, 1410 nt, Artificial Sequence
  derived and/or modified sequence opt4 from neuraminidase__InfluenzaA__ADD97464
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaccaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170882 - RNA, 1410 nt, Artificial Sequence; identical to SEQ ID NO: 169258
  derived and/or modified sequence opt4 from neuraminidase__InfluenzaA__ADD97474

SEQ ID NO: 170883 - RNA, 1410 nt, Artificial Sequence; identical to SEQ ID NO: 169258
  derived and/or modified sequence opt4 from neuraminidase__InfluenzaA__ADD97484

SEQ ID NO: 170884 - RNA, 1410 nt, Artificial Sequence
  derived and/or modified sequence opt4 from neuraminidase__InfluenzaA__ADD97494
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccccagcgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170885 - RNA, 1410 nt, Artificial Sequence; identical to SEQ ID NO: 169258
  derived and/or modified sequence opt4 from neuraminidase__InfluenzaA__ADD97504

SEQ ID NO: 170886 - RNA, 1410 nt, Artificial Sequence; identical to SEQ ID NO: 169258
  derived and/or modified sequence opt4 from neuraminidase__InfluenzaA__ADD97514

SEQ ID NO: 170887 - RNA, 1410 nt, Artificial Sequence; identical to SEQ ID NO: 170870
  derived and/or modified sequence opt4 from neuraminidase__InfluenzaA__ADD97534

SEQ ID NO: 170888 - RNA, 1410 nt, Artificial Sequence; identical to SEQ ID NO: 169258
  derived and/or modified sequence opt4 from neuraminidase__InfluenzaA__ADD97544

SEQ ID NO: 170889 - RNA, 1410 nt, Artificial Sequence; identical to SEQ ID NO: 169258
  derived and/or modified sequence opt4 from neuraminidase__InfluenzaA__ADD97554

SEQ ID NO: 170890 - RNA, 1410 nt, Artificial Sequence; identical to SEQ ID NO: 170874
  derived and/or modified sequence opt4 from neuraminidase__InfluenzaA__ADD97564

SEQ ID NO: 170891 - RNA, 1410 nt, Artificial Sequence; identical to SEQ ID NO: 169258
  derived and/or modified sequence opt4 from neuraminidase__InfluenzaA__ADD97574

SEQ ID NO: 170892 - RNA, 1410 nt, Artificial Sequence; identical to SEQ ID NO: 169258
  derived and/or modified sequence opt4 from neuraminidase__InfluenzaA__ADD97584

SEQ ID NO: 170893 - RNA, 1410 nt, Artificial Sequence
  derived and/or modified sequence opt4 from neuraminidase__InfluenzaA__ADD97681
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaucaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcaucaacagcgacaccgugggcuggagcuggcccgacggcgccgagcugcccuucaccaucgacaaguga

SEQ ID NO: 170894 - RNA, 1410 nt, Artificial Sequence; identical to SEQ ID NO: 170850
  derived and/or modified sequence opt4 from neuraminidase__InfluenzaA__ADD97691

SEQ ID NO: 170895 - RNA, 1410 nt, Artificial Sequence; identical to SEQ ID NO: 170395
  derived and/or modified sequence opt4 from neuraminidase__InfluenzaA__ADD97701

SEQ ID NO: 170896 - RNA, 1410 nt, Artificial Sequence; identical to SEQ ID NO: 169258
  derived and/or modified sequence opt4 from neuraminidase__InfluenzaA__ADD97891

SEQ ID NO: 170897 - RNA, 1410 nt, Artificial Sequence; identical to SEQ ID NO: 169258
  derived and/or modified sequence opt4 from neuraminidase__InfluenzaA__ADD97901

SEQ ID NO: 170898 - RNA, 1410 nt, Artificial Sequence; identical to SEQ ID NO: 169258
  derived and/or modified sequence opt4 from neuraminidase__InfluenzaA__ADD97911

SEQ ID NO: 170899 - RNA, 1410 nt, Artificial Sequence; identical to SEQ ID NO: 169258
  derived and/or modified sequence opt4 from neuraminidase__InfluenzaA__ADD97921

SEQ ID NO: 170900 - RNA, 1410 nt, Artificial Sequence; identical to SEQ ID NO: 169258
  derived and/or modified sequence opt4 from neuraminidase__InfluenzaA__ADD97931

SEQ ID NO: 170901 - RNA, 1410 nt, Artificial Sequence; identical to SEQ ID NO: 170025
  derived and/or modified sequence opt4 from neuraminidase__InfluenzaA__ADD97941

SEQ ID NO: 170902 - RNA, 1410 nt, Artificial Sequence
  derived and/or modified sequence opt4 from neuraminidase__InfluenzaA__ADD97951
augaaccccaaccagaagaucaucaccaucagcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170903 - RNA, 1410 nt, Artificial Sequence
  derived and/or modified sequence opt4 from neuraminidase__InfluenzaA__ADD97961
augaaccccaaccagaagaucaucaccaucggcagcgugugcaugaccaucggcauggugaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacgccagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170904 - RNA, 1410 nt, Artificial Sequence; identical to SEQ ID NO: 170850
  derived and/or modified sequence opt4 from neuraminidase__InfluenzaA__ADD97971

SEQ ID NO: 170905 - RNA, 1410 nt, Artificial Sequence; identical to SEQ ID NO: 169258
  derived and/or modified sequence opt4 from neuraminidase__InfluenzaA__ADD97981

SEQ ID NO: 170906 - RNA, 1410 nt, Artificial Sequence
  derived and/or modified sequence opt4 from neuraminidase__InfluenzaA__ADD97991
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaucggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170907 - RNA, 1410 nt, Artificial Sequence
  derived and/or modified sequence opt4 from neuraminidase__InfluenzaA__ADD98001
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccgugaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170908 - RNA, 1410 nt, Artificial Sequence; identical to SEQ ID NO: 169258
  derived and/or modified sequence opt4 from neuraminidase__InfluenzaA__ADD98011

SEQ ID NO: 170909 - RNA, 1410 nt, Artificial Sequence; identical to SEQ ID NO: 169258
  derived and/or modified sequence opt4 from neuraminidase__InfluenzaA__ADD98031

SEQ ID NO: 170910 - RNA, 1410 nt, Artificial Sequence; identical to SEQ ID NO: 170907
  derived and/or modified sequence opt4 from neuraminidase__InfluenzaA__ADD98041

SEQ ID NO: 170911 - RNA, 1410 nt, Artificial Sequence; identical to SEQ ID NO: 169258
  derived and/or modified sequence opt4 from neuraminidase__InfluenzaA__ADD98051

SEQ ID NO: 170912 - RNA, 1410 nt, Artificial Sequence; identical to SEQ ID NO: 169258
  derived and/or modified sequence opt4 from neuraminidase__InfluenzaA__ADD98061

SEQ ID NO: 170913 - RNA, 1410 nt, Artificial Sequence; identical to SEQ ID NO: 169258
  derived and/or modified sequence opt4 from neuraminidase__InfluenzaA__ADD98071

SEQ ID NO: 170914 - RNA, 1410 nt, Artificial Sequence; identical to SEQ ID NO: 169258
  derived and/or modified sequence opt4 from neuraminidase__InfluenzaA__ADD98081

SEQ ID NO: 170915 - RNA, 1410 nt, Artificial Sequence; identical to SEQ ID NO: 169258
  derived and/or modified sequence opt4 from neuraminidase__InfluenzaA__ADD98091

SEQ ID NO: 170916 - RNA, 1410 nt, Artificial Sequence; identical to SEQ ID NO: 170084
  derived and/or modified sequence opt4 from neuraminidase__InfluenzaA__ADD98101

SEQ ID NO: 170917 - RNA, 1410 nt, Artificial Sequence
  derived and/or modified sequence opt4 from neuraminidase__InfluenzaA__ADD98111
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcauccugggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170918 - RNA, 1410 nt, Artificial Sequence; identical to SEQ ID NO: 169258
  derived and/or modified sequence opt4 from neuraminidase__InfluenzaA__ADD98121

SEQ ID NO: 170919 - RNA, 1410 nt, Artificial Sequence; identical to SEQ ID NO: 169258
  derived and/or modified sequence opt4 from neuraminidase__InfluenzaA__ADD98131

SEQ ID NO: 170920 - RNA, 1410 nt, Artificial Sequence; identical to SEQ ID NO: 169258
  derived and/or modified sequence opt4 from neuraminidase__InfluenzaA__ADD98141

SEQ ID NO: 170921 - RNA, 1410 nt, Artificial Sequence; identical to SEQ ID NO: 169258
  derived and/or modified sequence opt4 from neuraminidase__InfluenzaA__ADD98151

SEQ ID NO: 170922 - RNA, 1410 nt, Artificial Sequence
  derived and/or modified sequence opt4 from neuraminidase__InfluenzaA__ADD98161
augaaccccaaccagaagaucaucaccaucggcagcgugugcaugaccaucggcauggccaaccugauccugcagaucggcaacaucaucagcaucuggaucagccacaccauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccagaaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170923 - RNA, 1410 nt, Artificial Sequence
  derived and/or modified sequence opt4 from neuraminidase__InfluenzaA__ADD98171
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagaccguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaagcaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170924 - RNA, 1410 nt, Artificial Sequence
  derived and/or modified sequence opt4 from neuraminidase__InfluenzaA__ADD98181
augaaccccaaccagaagaucaucaccaucggcagcgugugcaugaccaucggcauggccaaccugauccugcagaucggcaacaugaucagcaucuggaucagccacagcauccagcuggagaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170925 - RNA, 1410 nt, Artificial Sequence; identical to SEQ ID NO: 169258
  derived and/or modified sequence opt4 from neuraminidase__InfluenzaA__ADD98201

SEQ ID NO: 170926 - RNA, 1410 nt, Artificial Sequence; identical to SEQ ID NO: 169258
  derived and/or modified sequence opt4 from neuraminidase__InfluenzaA__ADD98211

SEQ ID NO: 170927 - RNA, 1410 nt, Artificial Sequence; identical to SEQ ID NO: 170481
  derived and/or modified sequence opt4 from neuraminidase__InfluenzaA__ADE20324

SEQ ID NO: 170928 - RNA, 1410 nt, Artificial Sequence; identical to SEQ ID NO: 170481
  derived and/or modified sequence opt4 from neuraminidase__InfluenzaA__ADE20334

SEQ ID NO: 170929 - RNA, 1410 nt, Artificial Sequence; identical to SEQ ID NO: 170481
  derived and/or modified sequence opt4 from neuraminidase__InfluenzaA__ADE20344

SEQ ID NO: 170930 - RNA, 1410 nt, Artificial Sequence; identical to SEQ ID NO: 170481
  derived and/or modified sequence opt4 from neuraminidase__InfluenzaA__ADE20354

SEQ ID NO: 170931 - RNA, 1410 nt, Artificial Sequence; identical to SEQ ID NO: 170481
  derived and/or modified sequence opt4 from neuraminidase__InfluenzaA__ADE20378

SEQ ID NO: 170932 - RNA, 1410 nt, Artificial Sequence; identical to SEQ ID NO: 170481
  derived and/or modified sequence opt4 from neuraminidase__InfluenzaA__ADE20391

SEQ ID NO: 170933 - RNA, 1410 nt, Artificial Sequence; identical to SEQ ID NO: 170481
  derived and/or modified sequence opt4 from neuraminidase__InfluenzaA__ADE20631

SEQ ID NO: 170934 - RNA, 1410 nt, Artificial Sequence; identical to SEQ ID NO: 170481
  derived and/or modified sequence opt4 from neuraminidase__InfluenzaA__ADE20641

SEQ ID NO: 170935 - RNA, 1410 nt, Artificial Sequence
  derived and/or modified sequence opt4 from neuraminidase__InfluenzaA__ADE20651
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggugggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170936 - RNA, 1410 nt, Artificial Sequence; identical to SEQ ID NO: 170481
  derived and/or modified sequence opt4 from neuraminidase__InfluenzaA__ADE20661

SEQ ID NO: 170937 - RNA, 1410 nt, Artificial Sequence; identical to SEQ ID NO: 170481
  derived and/or modified sequence opt4 from neuraminidase__InfluenzaA__ADE20671

SEQ ID NO: 170938 - RNA, 1410 nt, Artificial Sequence; identical to SEQ ID NO: 170481
  derived and/or modified sequence opt4 from neuraminidase__InfluenzaA__ADE20681

SEQ ID NO: 170939 - RNA, 1410 nt, Artificial Sequence
  derived and/or modified sequence opt4 from neuraminidase__InfluenzaA__ADE20701
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcgugaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170940 - RNA, 1410 nt, Artificial Sequence; identical to SEQ ID NO: 170481
  derived and/or modified sequence opt4 from neuraminidase__InfluenzaA__ADE20711

SEQ ID NO: 170941 - RNA, 1410 nt, Artificial Sequence
  derived and/or modified sequence opt4 from neuraminidase__InfluenzaA__ADE20721
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggugggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacagauga

SEQ ID NO: 170942 - RNA, 1410 nt, Artificial Sequence; identical to SEQ ID NO: 170939
  derived and/or modified sequence opt4 from neuraminidase__InfluenzaA__ADE20731

SEQ ID NO: 170943 - RNA, 1410 nt, Artificial Sequence; identical to SEQ ID NO: 170481
  derived and/or modified sequence opt4 from neuraminidase__InfluenzaA__ADE20741

SEQ ID NO: 170944 - RNA, 1410 nt, Artificial Sequence; identical to SEQ ID NO: 170481
  derived and/or modified sequence opt4 from neuraminidase__InfluenzaA__ADE20751

SEQ ID NO: 170945 - RNA, 1410 nt, Artificial Sequence; identical to SEQ ID NO: 170939
  derived and/or modified sequence opt4 from neuraminidase__InfluenzaA__ADE20761

SEQ ID NO: 170946 - RNA, 1410 nt, Artificial Sequence; identical to SEQ ID NO: 170939
  derived and/or modified sequence opt4 from neuraminidase__InfluenzaA__ADE20781

SEQ ID NO: 170947 - RNA, 1410 nt, Artificial Sequence; identical to SEQ ID NO: 169258
  derived and/or modified sequence opt4 from neuraminidase__InfluenzaA__ADE20791

SEQ ID NO: 170948 - RNA, 1410 nt, Artificial Sequence; identical to SEQ ID NO: 169258
  derived and/or modified sequence opt4 from neuraminidase__InfluenzaA__ADE20801

SEQ ID NO: 170949 - RNA, 1410 nt, Artificial Sequence; identical to SEQ ID NO: 169258
  derived and/or modified sequence opt4 from neuraminidase__InfluenzaA__ADE20811

SEQ ID NO: 170950 - RNA, 1410 nt, Artificial Sequence; identical to SEQ ID NO: 169258
  derived and/or modified sequence opt4 from neuraminidase__InfluenzaA__ADE20821

SEQ ID NO: 170951 - RNA, 1410 nt, Artificial Sequence; identical to SEQ ID NO: 169258
  derived and/or modified sequence opt4 from neuraminidase__InfluenzaA__ADE20831

SEQ ID NO: 170952 - RNA, 1410 nt, Artificial Sequence; identical to SEQ ID NO: 169258
  derived and/or modified sequence opt4 from neuraminidase__InfluenzaA__ADE20841

SEQ ID NO: 170953 - RNA, 1410 nt, Artificial Sequence; identical to SEQ ID NO: 169258
  derived and/or modified sequence opt4 from neuraminidase__InfluenzaA__ADE20851

SEQ ID NO: 170954 - RNA, 1410 nt, Artificial Sequence; identical to SEQ ID NO: 170874
  derived and/or modified sequence opt4 from neuraminidase__InfluenzaA__ADE20861

SEQ ID NO: 170955 - RNA, 1410 nt, Artificial Sequence; identical to SEQ ID NO: 169258
  derived and/or modified sequence opt4 from neuraminidase__InfluenzaA__ADE20871

SEQ ID NO: 170956 - RNA, 1410 nt, Artificial Sequence; identical to SEQ ID NO: 170870
  derived and/or modified sequence opt4 from neuraminidase__InfluenzaA__ADE20881

SEQ ID NO: 170957 - RNA, 1410 nt, Artificial Sequence; identical to SEQ ID NO: 169258
  derived and/or modified sequence opt4 from neuraminidase__InfluenzaA__ADE20891

SEQ ID NO: 170958 - RNA, 1410 nt, Artificial Sequence; identical to SEQ ID NO: 169258
  derived and/or modified sequence opt4 from neuraminidase__InfluenzaA__ADE20901

SEQ ID NO: 170959 - RNA, 1410 nt, Artificial Sequence; identical to SEQ ID NO: 169258
  derived and/or modified sequence opt4 from neuraminidase__InfluenzaA__ADE20911

SEQ ID NO: 170960 - RNA, 1410 nt, Artificial Sequence; identical to SEQ ID NO: 169258
  derived and/or modified sequence opt4 from neuraminidase__InfluenzaA__ADE20921

SEQ ID NO: 170961 - RNA, 1410 nt, Artificial Sequence
  derived and/or modified sequence opt4 from neuraminidase__InfluenzaA__ADE20931
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugcugagcaacggcgccaacggcgugaagggcuucagcuucaaguacggcaacggcguguggaucggcagaaccaagagcaucggcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170962 - RNA, 1410 nt, Artificial Sequence; identical to SEQ ID NO: 169258
  derived and/or modified sequence opt4 from neuraminidase__InfluenzaA__ADE20941

SEQ ID NO: 170963 - RNA, 1410 nt, Artificial Sequence
  derived and/or modified sequence opt4 from neuraminidase__InfluenzaA__ADE20951
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacguggugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170964 - RNA, 1410 nt, Artificial Sequence
  derived and/or modified sequence opt4 from neuraminidase__InfluenzaA__ADE20961
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacgacaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170965 - RNA, 1410 nt, Artificial Sequence; identical to SEQ ID NO: 169258
  derived and/or modified sequence opt4 from neuraminidase__InfluenzaA__ADE20971

SEQ ID NO: 170966 - RNA, 1410 nt, Artificial Sequence; identical to SEQ ID NO: 170874
  derived and/or modified sequence opt4 from neuraminidase__InfluenzaA__ADE20981

SEQ ID NO: 170967 - RNA, 1410 nt, Artificial Sequence; identical to SEQ ID NO: 169258
  derived and/or modified sequence opt4 from neuraminidase__InfluenzaA__ADE20991

SEQ ID NO: 170968 - RNA, 1410 nt, Artificial Sequence
  derived and/or modified sequence opt4 from neuraminidase__InfluenzaA__ADE21001
augaaccccaaccagaagaucaucaccaucggcagcgugugcaugaccaucggcauggccaaccugauccugcagaucggcaacaucaucagcaucuggaucagccacaccauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucaucaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170969 - RNA, 1410 nt, Artificial Sequence; identical to SEQ ID NO: 169258
  derived and/or modified sequence opt4 from neuraminidase__InfluenzaA__ADE21011

SEQ ID NO: 170970 - RNA, 1410 nt, Artificial Sequence; identical to SEQ ID NO: 169258
  derived and/or modified sequence opt4 from neuraminidase__InfluenzaA__ADE21021

SEQ ID NO: 170971 - RNA, 1410 nt, Artificial Sequence; identical to SEQ ID NO: 170907
  derived and/or modified sequence opt4 from neuraminidase__InfluenzaA__ADE21031

SEQ ID NO: 170972 - RNA, 1410 nt, Artificial Sequence
  derived and/or modified sequence opt4 from neuraminidase__InfluenzaA__ADE21041
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcaucgagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170973 - RNA, 1410 nt, Artificial Sequence; identical to SEQ ID NO: 169258
  derived and/or modified sequence opt4 from neuraminidase__InfluenzaA__ADE21051

SEQ ID NO: 170974 - RNA, 1410 nt, Artificial Sequence
  derived and/or modified sequence opt4 from neuraminidase__InfluenzaA__ADE21071
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170975 - RNA, 1413 nt, Artificial Sequence; identical to SEQ ID NO: 169152
  derived and/or modified sequence opt4 from neuraminidase__InfluenzaA__ADE28752

SEQ ID NO: 170976 - RNA, 1413 nt, Artificial Sequence; identical to SEQ ID NO: 169981
  derived and/or modified sequence opt4 from neuraminidase__InfluenzaA__ADE28763

SEQ ID NO: 170977 - RNA, 1410 nt, Artificial Sequence; identical to SEQ ID NO: 170481
  derived and/or modified sequence opt4 from neuraminidase__InfluenzaA__ADE28773

SEQ ID NO: 170978 - RNA, 1410 nt, Artificial Sequence; identical to SEQ ID NO: 170481
  derived and/or modified sequence opt4 from neuraminidase__InfluenzaA__ADE28783

SEQ ID NO: 170979 - RNA, 1410 nt, Artificial Sequence; identical to SEQ ID NO: 170939
  derived and/or modified sequence opt4 from neuraminidase__InfluenzaA__ADE28803

SEQ ID NO: 170980 - RNA, 1410 nt, Artificial Sequence; identical to SEQ ID NO: 169258
  derived and/or modified sequence opt4 from neuraminidase__InfluenzaA__ADE28813

SEQ ID NO: 170981 - RNA, 1410 nt, Artificial Sequence; identical to SEQ ID NO: 169258
  derived and/or modified sequence opt4 from neuraminidase__InfluenzaA__ADE28823

SEQ ID NO: 170982 - RNA, 1410 nt, Artificial Sequence
  derived and/or modified sequence opt4 from neuraminidase__InfluenzaA__ADE28843
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccgugggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170983 - RNA, 1410 nt, Artificial Sequence
  derived and/or modified sequence opt4 from neuraminidase__InfluenzaA__ADE28853
augaaccccaaccagaagaucaucaccaucgugagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170984 - RNA, 1410 nt, Artificial Sequence; identical to SEQ ID NO: 170982
  derived and/or modified sequence opt4 from neuraminidase__InfluenzaA__ADE28884

SEQ ID NO: 170985 - RNA, 1410 nt, Artificial Sequence
  derived and/or modified sequence opt4 from neuraminidase__InfluenzaA__ADE28894
augaaccccaaccagaagaucaucaccaucggcagcgugugcaugaccaucggcauggccaaccugauccugcagaucggcaacaucaucagcaucuggaucagccacagcgugcagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170986 - RNA, 1410 nt, Artificial Sequence; identical to SEQ ID NO: 170906
  derived and/or modified sequence opt4 from neuraminidase__InfluenzaA__ADE28904

SEQ ID NO: 170987 - RNA, 1410 nt, Artificial Sequence; identical to SEQ ID NO: 169258
  derived and/or modified sequence opt4 from neuraminidase__InfluenzaA__ADE28914

SEQ ID NO: 170988 - RNA, 1410 nt, Artificial Sequence; identical to SEQ ID NO: 169258
  derived and/or modified sequence opt4 from neuraminidase__InfluenzaA__ADE28924

SEQ ID NO: 170989 - RNA, 1410 nt, Artificial Sequence
  derived and/or modified sequence opt4 from neuraminidase__InfluenzaA__ADE28934
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcaucaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170990 - RNA, 1410 nt, Artificial Sequence; identical to SEQ ID NO: 169258
  derived and/or modified sequence opt4 from neuraminidase__InfluenzaA__ADE28954

SEQ ID NO: 170991 - RNA, 1410 nt, Artificial Sequence
  derived and/or modified sequence opt4 from neuraminidase__InfluenzaA__ADE28964
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaucaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170992 - RNA, 1410 nt, Artificial Sequence; identical to SEQ ID NO: 169258
  derived and/or modified sequence opt4 from neuraminidase__InfluenzaA__ADE28974

SEQ ID NO: 170993 - RNA, 1410 nt, Artificial Sequence
  derived and/or modified sequence opt4 from neuraminidase__InfluenzaA__ADE29004
augaaccccaaccagaagaucaucaccaucggcagcgugugcaugaccaucggccuggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaagaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170994 - RNA, 1410 nt, Artificial Sequence; identical to SEQ ID NO: 169258
  derived and/or modified sequence opt4 from neuraminidase__InfluenzaA__ADE29014

SEQ ID NO: 170995 - RNA, 1410 nt, Artificial Sequence
  derived and/or modified sequence opt4 from neuraminidase__InfluenzaA__ADE29024
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggaagaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaacggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 170996 - RNA, 1410 nt, Artificial Sequence; identical to SEQ ID NO: 169258
  derived and/or modified sequence opt4 from neuraminidase__InfluenzaA__ADE29034

SEQ ID NO: 170997 - RNA, 1410 nt, Artificial Sequence; identical to SEQ ID NO: 169258
  derived and/or modified sequence opt4 from neuraminidase__InfluenzaA__ADE29044

SEQ ID NO: 170998 - RNA, 1410 nt, Artificial Sequence; identical to SEQ ID NO: 169258
  derived and/or modified sequence opt4 from neuraminidase__InfluenzaA__ADE29054

SEQ ID NO: 170999 - RNA, 1410 nt, Artificial Sequence; identical to SEQ ID NO: 170546
  derived and/or modified sequence opt4 from neuraminidase__InfluenzaA__ADE29064

SEQ ID NO: 171000 - RNA, 1410 nt, Artificial Sequence
  derived and/or modified sequence opt4 from neuraminidase__InfluenzaA__ADE29087
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcaagaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171001 - RNA, 1410 nt, Artificial Sequence; identical to SEQ ID NO: 169248
  derived and/or modified sequence opt4 from neuraminidase__InfluenzaA__ADE29097

SEQ ID NO: 171002 - RNA, 1410 nt, Artificial Sequence; identical to SEQ ID NO: 170125
  derived and/or modified sequence opt4 from neuraminidase__InfluenzaA__ADE34194

SEQ ID NO: 171003 - RNA, 1410 nt, Artificial Sequence; identical to SEQ ID NO: 169119
  derived and/or modified sequence opt4 from neuraminidase__InfluenzaA__ADE34205

SEQ ID NO: 171004 - RNA, 1410 nt, Artificial Sequence
  derived and/or modified sequence opt4 from neuraminidase__InfluenzaA__ADE34216
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171005 - RNA, 1410 nt, Artificial Sequence; identical to SEQ ID NO: 170125
  derived and/or modified sequence opt4 from neuraminidase__InfluenzaA__ADE34227

SEQ ID NO: 171006 - RNA, 1410 nt, Artificial Sequence; identical to SEQ ID NO: 170125
  derived and/or modified sequence opt4 from neuraminidase__InfluenzaA__ADE34238

SEQ ID NO: 171007 - RNA, 1410 nt, Artificial Sequence
  derived and/or modified sequence opt4 from neuraminidase__InfluenzaA__ADE34260
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugagcaucuga

SEQ ID NO: 171008 - RNA, 1410 nt, Artificial Sequence; identical to SEQ ID NO: 170125
  derived and/or modified sequence opt4 from neuraminidase__InfluenzaA__ADE34271

SEQ ID NO: 171009 - RNA, 1410 nt, Artificial Sequence; identical to SEQ ID NO: 169258
  derived and/or modified sequence opt4 from neuraminidase__InfluenzaA__ADE45502

SEQ ID NO: 171010 - RNA, 1410 nt, Artificial Sequence; identical to SEQ ID NO: 169258
  derived and/or modified sequence opt4 from neuraminidase__InfluenzaA__ADE45504

SEQ ID NO: 171011 - RNA, 1410 nt, Artificial Sequence; identical to SEQ ID NO: 169258
  derived and/or modified sequence opt4 from neuraminidase__InfluenzaA__ADE45506

SEQ ID NO: 171012 - RNA, 1410 nt, Artificial Sequence; identical to SEQ ID NO: 169258
  derived and/or modified sequence opt4 from neuraminidase__InfluenzaA__ADE45508

SEQ ID NO: 171013 - RNA, 1410 nt, Artificial Sequence; identical to SEQ ID NO: 169258
  derived and/or modified sequence opt4 from neuraminidase__InfluenzaA__ADE45510

SEQ ID NO: 171014 - RNA, 1410 nt, Artificial Sequence; identical to SEQ ID NO: 169258
  derived and/or modified sequence opt4 from neuraminidase__InfluenzaA__ADE45512

SEQ ID NO: 171015 - RNA, 1410 nt, Artificial Sequence
  derived and/or modified sequence opt4 from neuraminidase__InfluenzaA__ADE45514
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuuccaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171016 - RNA, 1410 nt, Artificial Sequence
  derived and/or modified sequence opt4 from neuraminidase__InfluenzaA__ADE45516
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagccugagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171017 - RNA, 1410 nt, Artificial Sequence
  derived and/or modified sequence opt4 from neuraminidase__InfluenzaA__ADF10069
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcacccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171018 - RNA, 1410 nt, Artificial Sequence; identical to SEQ ID NO: 169258
  derived and/or modified sequence opt4 from neuraminidase__InfluenzaA__ADF10079

SEQ ID NO: 171019 - RNA, 1410 nt, Artificial Sequence; identical to SEQ ID NO: 169258
  derived and/or modified sequence opt4 from neuraminidase__InfluenzaA__ADF10089

SEQ ID NO: 171020 - RNA, 1410 nt, Artificial Sequence; identical to SEQ ID NO: 169258
  derived and/or modified sequence opt4 from neuraminidase__InfluenzaA__ADF10099

SEQ ID NO: 171021 - RNA, 1410 nt, Artificial Sequence
  derived and/or modified sequence opt4 from neuraminidase__InfluenzaA__ADF10109
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcaacugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171022 - RNA, 1410 nt, Artificial Sequence; identical to SEQ ID NO: 169258
  derived and/or modified sequence opt4 from neuraminidase__InfluenzaA__ADF10129

SEQ ID NO: 171023 - RNA, 1410 nt, Artificial Sequence; identical to SEQ ID NO: 170688
  derived and/or modified sequence opt4 from neuraminidase__InfluenzaA__ADF10146

SEQ ID NO: 171024 - RNA, 1410 nt, Artificial Sequence
  derived and/or modified sequence opt4 from neuraminidase__InfluenzaA__ADF10166
augaaccccaaccagaagaucaucaccaucggcagcgugugcaugaucaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171025 - RNA, 1410 nt, Artificial Sequence; identical to SEQ ID NO: 171024
  derived and/or modified sequence opt4 from neuraminidase__InfluenzaA__ADF10176

SEQ ID NO: 171026 - RNA, 1410 nt, Artificial Sequence; identical to SEQ ID NO: 171024
  derived and/or modified sequence opt4 from neuraminidase__InfluenzaA__ADF10192

SEQ ID NO: 171027 - RNA, 1410 nt, Artificial Sequence; identical to SEQ ID NO: 169258
  derived and/or modified sequence opt4 from neuraminidase__InfluenzaA__ADF10247

SEQ ID NO: 171028 - RNA, 1410 nt, Artificial Sequence; identical to SEQ ID NO: 171024
  derived and/or modified sequence opt4 from neuraminidase__InfluenzaA__ADF10290

SEQ ID NO: 171029 - RNA, 1410 nt, Artificial Sequence
  derived and/or modified sequence opt4 from neuraminidase__InfluenzaA__ADF10304
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccggccugcccuucaccaucgacaaguga

SEQ ID NO: 171030 - RNA, 1410 nt, Artificial Sequence; identical to SEQ ID NO: 169258
  derived and/or modified sequence opt4 from neuraminidase__InfluenzaA__ADF10340

SEQ ID NO: 171031 - RNA, 1410 nt, Artificial Sequence; identical to SEQ ID NO: 169258
  derived and/or modified sequence opt4 from neuraminidase__InfluenzaA__ADF10361

SEQ ID NO: 171032 - RNA, 1410 nt, Artificial Sequence; identical to SEQ ID NO: 171024
  derived and/or modified sequence opt4 from neuraminidase__InfluenzaA__ADF10371

SEQ ID NO: 171033 - RNA, 1410 nt, Artificial Sequence; identical to SEQ ID NO: 171024
  derived and/or modified sequence opt4 from neuraminidase__InfluenzaA__ADF10407

SEQ ID NO: 171034 - RNA, 1410 nt, Artificial Sequence; identical to SEQ ID NO: 169258
  derived and/or modified sequence opt4 from neuraminidase__InfluenzaA__ADF10472

SEQ ID NO: 171035 - RNA, 1410 nt, Artificial Sequence; identical to SEQ ID NO: 171024
  derived and/or modified sequence opt4 from neuraminidase__InfluenzaA__ADF10616

SEQ ID NO: 171036 - RNA, 1410 nt, Artificial Sequence; identical to SEQ ID NO: 171024
  derived and/or modified sequence opt4 from neuraminidase__InfluenzaA__ADF10688

SEQ ID NO: 171037 - RNA, 1410 nt, Artificial Sequence; identical to SEQ ID NO: 171024
  derived and/or modified sequence opt4 from neuraminidase__InfluenzaA__ADF10726

SEQ ID NO: 171038 - RNA, 1410 nt, Artificial Sequence; identical to SEQ ID NO: 169258
  derived and/or modified sequence opt4 from neuraminidase__InfluenzaA__ADF10773

SEQ ID NO: 171039 - RNA, 1410 nt, Artificial Sequence
  derived and/or modified sequence opt4 from neuraminidase__InfluenzaA__ADF10837
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggaagaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171040 - RNA, 1410 nt, Artificial Sequence; identical to SEQ ID NO: 169258
  derived and/or modified sequence opt4 from neuraminidase__InfluenzaA__ADF10889

SEQ ID NO: 171041 - RNA, 1410 nt, Artificial Sequence; identical to SEQ ID NO: 169258
  derived and/or modified sequence opt4 from neuraminidase__InfluenzaA__ADF10947

SEQ ID NO: 171042 - RNA, 1410 nt, Artificial Sequence; identical to SEQ ID NO: 169258
  derived and/or modified sequence opt4 from neuraminidase__InfluenzaA__ADF11010

SEQ ID NO: 171043 - RNA, 1410 nt, Artificial Sequence
  derived and/or modified sequence opt4 from neuraminidase__InfluenzaA__ADF27355
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaugggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171044 - RNA, 1410 nt, Artificial Sequence
  derived and/or modified sequence opt4 from neuraminidase__InfluenzaA__ADF27356
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagaacgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171045 - RNA, 1410 nt, Artificial Sequence; identical to SEQ ID NO: 169612
  derived and/or modified sequence opt4 from neuraminidase__InfluenzaA__ADF27357

SEQ ID NO: 171046 - RNA, 1410 nt, Artificial Sequence; identical to SEQ ID NO: 169612
  derived and/or modified sequence opt4 from neuraminidase__InfluenzaA__ADF27358

SEQ ID NO: 171047 - RNA, 1410 nt, Artificial Sequence; identical to SEQ ID NO: 169612
  derived and/or modified sequence opt4 from neuraminidase__InfluenzaA__ADF27360

SEQ ID NO: 171048 - RNA, 1410 nt, Artificial Sequence; identical to SEQ ID NO: 169258
  derived and/or modified sequence opt4 from neuraminidase__InfluenzaA__ADF27361

SEQ ID NO: 171049 - RNA, 1410 nt, Artificial Sequence; identical to SEQ ID NO: 169258
  derived and/or modified sequence opt4 from neuraminidase__InfluenzaA__ADF27362

SEQ ID NO: 171050 - RNA, 1410 nt, Artificial Sequence; identical to SEQ ID NO: 169258
  derived and/or modified sequence opt4 from neuraminidase__InfluenzaA__ADF27363

SEQ ID NO: 171051 - RNA, 1410 nt, Artificial Sequence; identical to SEQ ID NO: 169612
  derived and/or modified sequence opt4 from neuraminidase__InfluenzaA__ADF27364

SEQ ID NO: 171052 - RNA, 1410 nt, Artificial Sequence; identical to SEQ ID NO: 169258
  derived and/or modified sequence opt4 from neuraminidase__InfluenzaA__ADF27365

SEQ ID NO: 171053 - RNA, 1410 nt, Artificial Sequence; identical to SEQ ID NO: 169612
  derived and/or modified sequence opt4 from neuraminidase__InfluenzaA__ADF27366

SEQ ID NO: 171054 - RNA, 1410 nt, Artificial Sequence; identical to SEQ ID NO: 169258
  derived and/or modified sequence opt4 from neuraminidase__InfluenzaA__ADF27382

SEQ ID NO: 171055 - RNA, 1410 nt, Artificial Sequence; identical to SEQ ID NO: 169258
  derived and/or modified sequence opt4 from neuraminidase__InfluenzaA__ADF27392

SEQ ID NO: 171056 - RNA, 1410 nt, Artificial Sequence; identical to SEQ ID NO: 169258
  derived and/or modified sequence opt4 from neuraminidase__InfluenzaA__ADF27402

SEQ ID NO: 171057 - RNA, 1410 nt, Artificial Sequence; identical to SEQ ID NO: 171039
  derived and/or modified sequence opt4 from neuraminidase__InfluenzaA__ADF27422

SEQ ID NO: 171058 - RNA, 1410 nt, Artificial Sequence
  derived and/or modified sequence opt4 from neuraminidase__InfluenzaA__ADF27432
augaaccccaaccagaagaucaucaccaucggcagcgugugcgugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171059 - RNA, 1410 nt, Artificial Sequence
  derived and/or modified sequence opt4 from neuraminidase__InfluenzaA__ADF27442
augaaccccaaccagaagaucaucaccaucggcagcgugugcaugaccaucggcauggccaaccugauccugcagaucggcaacaucaucagcaucuggaucagccacagcauccagcuggagaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171060 - RNA, 1410 nt, Artificial Sequence
  derived and/or modified sequence opt4 from neuraminidase__InfluenzaA__ADF27462
augaaccccaaccagaagaucaucaccaucggcagcgugugcaugaccaucggcauggccaaccugauccugcagaucggcaacaucaucagcaucuggaucagccacagcauccagcugggcaaccagaaccagaucgaggccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccguguacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171061 - RNA, 1410 nt, Artificial Sequence; identical to SEQ ID NO: 169258
  derived and/or modified sequence opt4 from neuraminidase__InfluenzaA__ADF27472

SEQ ID NO: 171062 - RNA, 1410 nt, Artificial Sequence
  derived and/or modified sequence opt4 from neuraminidase__InfluenzaA__ADF27482
augaaccccaaccagaagaucaucaccaucggcagcgugugcaugaccaucggcauggccaaccugauccugcagaucggcaacaucaucagcaucuggaucagccacagcauccagcugggcaaccagaaccagguggagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171063 - RNA, 1410 nt, Artificial Sequence
  derived and/or modified sequence opt4 from neuraminidase__InfluenzaA__ADF27492
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagcccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcaucgagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 171064 - RNA, 1410 nt, Artificial Sequence; identical to SEQ ID NO: 169258
  derived and/or modified sequence opt4 from neuraminidase__InfluenzaA__ADF27502

SEQ ID NO: 171065 - RNA, 1410 nt, Artificial Sequence; identical to SEQ ID NO: 169258
  derived and/or modified sequence opt4 from neuraminidase__InfluenzaA__ADF27512

SEQ ID NO: 171066 - RNA, 1410 nt, Artificial Sequence
  derived and/or modified sequence opt4 from neuraminidase__InfluenzaA__ADF27522
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaucaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171067 - RNA, 1410 nt, Artificial Sequence; identical to SEQ ID NO: 169258
  derived and/or modified sequence opt4 from neuraminidase__InfluenzaA__ADF27532

SEQ ID NO: 171068 - RNA, 1410 nt, Artificial Sequence
  derived and/or modified sequence opt4 from neuraminidase__InfluenzaA__ADF27542
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171069 - RNA, 1410 nt, Artificial Sequence
  derived and/or modified sequence opt4 from neuraminidase__InfluenzaA__ADF27552
augaaccccaaccagaagaucaucaccaucggcagcgugugcaugaccaucggccuggccaaccugauccugcagaucggcaacaucaucagcaucugggugagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaagaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171070 - RNA, 1410 nt, Artificial Sequence; identical to SEQ ID NO: 170084
  derived and/or modified sequence opt4 from neuraminidase__InfluenzaA__ADF27562

SEQ ID NO: 171071 - RNA, 1410 nt, Artificial Sequence; identical to SEQ ID NO: 169258
  derived and/or modified sequence opt4 from neuraminidase__InfluenzaA__ADF27572

SEQ ID NO: 171072 - RNA, 1410 nt, Artificial Sequence
  derived and/or modified sequence opt4 from neuraminidase__InfluenzaA__ADF27582
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171073 - RNA, 1410 nt, Artificial Sequence; identical to SEQ ID NO: 169258
  derived and/or modified sequence opt4 from neuraminidase__InfluenzaA__ADF27592

SEQ ID NO: 171074 - RNA, 1410 nt, Artificial Sequence
  derived and/or modified sequence opt4 from neuraminidase__InfluenzaA__ADF27602
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagagaggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171075 - RNA, 1410 nt, Artificial Sequence; identical to SEQ ID NO: 169258
  derived and/or modified sequence opt4 from neuraminidase__InfluenzaA__ADF27612

SEQ ID NO: 171076 - RNA, 1410 nt, Artificial Sequence; identical to SEQ ID NO: 170546
  derived and/or modified sequence opt4 from neuraminidase__InfluenzaA__ADF27622

SEQ ID NO: 171077 - RNA, 1410 nt, Artificial Sequence; identical to SEQ ID NO: 170993
  derived and/or modified sequence opt4 from neuraminidase__InfluenzaA__ADF27632

SEQ ID NO: 171078 - RNA, 1410 nt, Artificial Sequence; identical to SEQ ID NO: 169258
  derived and/or modified sequence opt4 from neuraminidase__InfluenzaA__ADF27642

SEQ ID NO: 171079 - RNA, 1410 nt, Artificial Sequence; identical to SEQ ID NO: 169258
  derived and/or modified sequence opt4 from neuraminidase__InfluenzaA__ADF27652

SEQ ID NO: 171080 - RNA, 1410 nt, Artificial Sequence
  derived and/or modified sequence opt4 from neuraminidase__InfluenzaA__ADF27662
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugcaacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171081 - RNA, 1410 nt, Artificial Sequence; identical to SEQ ID NO: 169258
  derived and/or modified sequence opt4 from neuraminidase__InfluenzaA__ADF27672

SEQ ID NO: 171082 - RNA, 1410 nt, Artificial Sequence; identical to SEQ ID NO: 169258
  derived and/or modified sequence opt4 from neuraminidase__InfluenzaA__ADF27682

SEQ ID NO: 171083 - RNA, 1410 nt, Artificial Sequence; identical to SEQ ID NO: 169258
  derived and/or modified sequence opt4 from neuraminidase__InfluenzaA__ADF27692

SEQ ID NO: 171084 - RNA, 1410 nt, Artificial Sequence; identical to SEQ ID NO: 169258
  derived and/or modified sequence opt4 from neuraminidase__InfluenzaA__ADF27702

SEQ ID NO: 171085 - RNA, 1410 nt, Artificial Sequence; identical to SEQ ID NO: 169258
  derived and/or modified sequence opt4 from neuraminidase__InfluenzaA__ADF27712

SEQ ID NO: 171086 - RNA, 1410 nt, Artificial Sequence; identical to SEQ ID NO: 170546
  derived and/or modified sequence opt4 from neuraminidase__InfluenzaA__ADF27788

SEQ ID NO: 171087 - RNA, 1410 nt, Artificial Sequence; identical to SEQ ID NO: 170501
  derived and/or modified sequence opt4 from neuraminidase__InfluenzaA__ADF27798

SEQ ID NO: 171088 - RNA, 1410 nt, Artificial Sequence; identical to SEQ ID NO: 170993
  derived and/or modified sequence opt4 from neuraminidase__InfluenzaA__ADF27808

SEQ ID NO: 171089 - RNA, 1410 nt, Artificial Sequence
  derived and/or modified sequence opt4 from neuraminidase__InfluenzaA__ADF27818
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaacagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171090 - RNA, 1410 nt, Artificial Sequence; identical to SEQ ID NO: 169258
  derived and/or modified sequence opt4 from neuraminidase__InfluenzaA__ADF27838

SEQ ID NO: 171091 - RNA, 1410 nt, Artificial Sequence; identical to SEQ ID NO: 169258
  derived and/or modified sequence opt4 from neuraminidase__InfluenzaA__ADF27848

SEQ ID NO: 171092 - RNA, 1410 nt, Artificial Sequence
  derived and/or modified sequence opt4 from neuraminidase__InfluenzaA__ADF27858
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcagcagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacggcgacaccgugggcuggagcuggcccgacggcgccgagcugcccuucaccaucgacaaguga

SEQ ID NO: 171093 - RNA, 1410 nt, Artificial Sequence
  derived and/or modified sequence opt4 from neuraminidase__InfluenzaA__ADF27878
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacggcgacaccgugggcuggagcuggcccgacggcgccgagcugcccuucaccaucgacaaguga

SEQ ID NO: 171094 - RNA, 1410 nt, Artificial Sequence; identical to SEQ ID NO: 170546
  derived and/or modified sequence opt4 from neuraminidase__InfluenzaA__ADF27888

SEQ ID NO: 171095 - RNA, 1410 nt, Artificial Sequence; identical to SEQ ID NO: 169258
  derived and/or modified sequence opt4 from neuraminidase__InfluenzaA__ADF27898

SEQ ID NO: 171096 - RNA, 1410 nt, Artificial Sequence; identical to SEQ ID NO: 170546
  derived and/or modified sequence opt4 from neuraminidase__InfluenzaA__ADF27908

SEQ ID NO: 171097 - RNA, 1410 nt, Artificial Sequence; identical to SEQ ID NO: 170546
  derived and/or modified sequence opt4 from neuraminidase__InfluenzaA__ADF27918

SEQ ID NO: 171098 - RNA, 1410 nt, Artificial Sequence
  derived and/or modified sequence opt4 from neuraminidase__InfluenzaA__ADF27938
augaaccccaaccagagaaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaugagcuucugcggcgugaacagcgacaccgugggcuggagcuggcccgacggcgccgagcugcccuucaccaucgacaaguga

SEQ ID NO: 171099 - RNA, 1410 nt, Artificial Sequence; identical to SEQ ID NO: 169258
  derived and/or modified sequence opt4 from neuraminidase__InfluenzaA__ADF27948

SEQ ID NO: 171100 - RNA, 1410 nt, Artificial Sequence; identical to SEQ ID NO: 170546
  derived and/or modified sequence opt4 from neuraminidase__InfluenzaA__ADF27958

SEQ ID NO: 171101 - RNA, 1410 nt, Artificial Sequence; identical to SEQ ID NO: 169258
  derived and/or modified sequence opt4 from neuraminidase__InfluenzaA__ADF27968

SEQ ID NO: 171102 - RNA, 1410 nt, Artificial Sequence; identical to SEQ ID NO: 170546
  derived and/or modified sequence opt4 from neuraminidase__InfluenzaA__ADF27978

SEQ ID NO: 171103 - RNA, 1410 nt, Artificial Sequence
  derived and/or modified sequence opt4 from neuraminidase__InfluenzaA__ADF27988
augaaccccaaccagaagaucaucaccaucggcagcgugugcaugaccaucggccuggccaaccugauccugcagaucggcaacaucaucagcaucuggaucagccacagcauccagcugggcaaccagaaccagaucgagaccugcaaccagagcgugaucagcuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaagaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171104 - RNA, 1410 nt, Artificial Sequence; identical to SEQ ID NO: 169258
  derived and/or modified sequence opt4 from neuraminidase__InfluenzaA__ADF27998

SEQ ID NO: 171105 - RNA, 1410 nt, Artificial Sequence; identical to SEQ ID NO: 169258
  derived and/or modified sequence opt4 from neuraminidase__InfluenzaA__ADF28008

SEQ ID NO: 171106 - RNA, 1410 nt, Artificial Sequence; identical to SEQ ID NO: 170145
  derived and/or modified sequence opt4 from neuraminidase__InfluenzaA__ADF28018

SEQ ID NO: 171107 - RNA, 1410 nt, Artificial Sequence; identical to SEQ ID NO: 169258
  derived and/or modified sequence opt4 from neuraminidase__InfluenzaA__ADF28028

SEQ ID NO: 171108 - RNA, 1410 nt, Artificial Sequence
  derived and/or modified sequence opt4 from neuraminidase__InfluenzaA__ADF28038
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccaccggccagcugguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacagacacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171109 - RNA, 1410 nt, Artificial Sequence; identical to SEQ ID NO: 169258
  derived and/or modified sequence opt4 from neuraminidase__InfluenzaA__ADF28048

SEQ ID NO: 171110 - RNA, 1410 nt, Artificial Sequence; identical to SEQ ID NO: 169258
  derived and/or modified sequence opt4 from neuraminidase__InfluenzaA__ADF28058

SEQ ID NO: 171111 - RNA, 1410 nt, Artificial Sequence
  derived and/or modified sequence opt4 from neuraminidase__InfluenzaA__ADF28068
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcagcagcagccugugccccgugagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171112 - RNA, 1410 nt, Artificial Sequence; identical to SEQ ID NO: 169258
  derived and/or modified sequence opt4 from neuraminidase__InfluenzaA__ADF28078

SEQ ID NO: 171113 - RNA, 1410 nt, Artificial Sequence; identical to SEQ ID NO: 169258
  derived and/or modified sequence opt4 from neuraminidase__InfluenzaA__ADF28088

SEQ ID NO: 171114 - RNA, 1410 nt, Artificial Sequence; identical to SEQ ID NO: 170720
  derived and/or modified sequence opt4 from neuraminidase__InfluenzaA__ADF28110

SEQ ID NO: 171115 - RNA, 1410 nt, Artificial Sequence; identical to SEQ ID NO: 169258
  derived and/or modified sequence opt4 from neuraminidase__InfluenzaA__ADF28120

SEQ ID NO: 171116 - RNA, 1410 nt, Artificial Sequence; identical to SEQ ID NO: 169258
  derived and/or modified sequence opt4 from neuraminidase__InfluenzaA__ADF29919

SEQ ID NO: 171117 - RNA, 1410 nt, Artificial Sequence; identical to SEQ ID NO: 170395
  derived and/or modified sequence opt4 from neuraminidase__InfluenzaA__ADF42692

SEQ ID NO: 171118 - RNA, 1410 nt, Artificial Sequence; identical to SEQ ID NO: 169258
  derived and/or modified sequence opt4 from neuraminidase__InfluenzaA__ADF42702

SEQ ID NO: 171119 - RNA, 1410 nt, Artificial Sequence; identical to SEQ ID NO: 171093
  derived and/or modified sequence opt4 from neuraminidase__InfluenzaA__ADF42712

SEQ ID NO: 171120 - RNA, 1410 nt, Artificial Sequence; identical to SEQ ID NO: 169258
  derived and/or modified sequence opt4 from neuraminidase__InfluenzaA__ADF42722

SEQ ID NO: 171121 - RNA, 1410 nt, Artificial Sequence; identical to SEQ ID NO: 170546
  derived and/or modified sequence opt4 from neuraminidase__InfluenzaA__ADF42732

SEQ ID NO: 171122 - RNA, 1410 nt, Artificial Sequence; identical to SEQ ID NO: 169258
  derived and/or modified sequence opt4 from neuraminidase__InfluenzaA__ADF42742

SEQ ID NO: 171123 - RNA, 1410 nt, Artificial Sequence; identical to SEQ ID NO: 169248
  derived and/or modified sequence opt4 from neuraminidase__InfluenzaA__ADF58339

SEQ ID NO: 171124 - RNA, 1410 nt, Artificial Sequence; identical to SEQ ID NO: 169258
  derived and/or modified sequence opt4 from neuraminidase__InfluenzaA__ADF58348

SEQ ID NO: 171125 - RNA, 1410 nt, Artificial Sequence; identical to SEQ ID NO: 169258
  derived and/or modified sequence opt4 from neuraminidase__InfluenzaA__ADF58350

SEQ ID NO: 171126 - RNA, 1410 nt, Artificial Sequence; identical to SEQ ID NO: 169258
  derived and/or modified sequence opt4 from neuraminidase__InfluenzaA__ADF58352

SEQ ID NO: 171127 - RNA, 1410 nt, Artificial Sequence
  derived and/or modified sequence opt4 from neuraminidase__InfluenzaA__ADF80459
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugaccuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 171128 - RNA, 1410 nt, Artificial Sequence
  derived and/or modified sequence opt4 from neuraminidase__InfluenzaA__ADF80503
augaaccccaaccagaagaucaucaccaucggcagcgugugcaugaccaucggcauggccaaccugauccugcagaucggcaacaucaccagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171129 - RNA, 1410 nt, Artificial Sequence
  derived and/or modified sequence opt4 from neuraminidase__InfluenzaA__ADF83744
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagaagaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171130 - RNA, 1410 nt, Artificial Sequence; identical to SEQ ID NO: 170112
  derived and/or modified sequence opt4 from neuraminidase__InfluenzaA__ADF83755

SEQ ID NO: 171131 - RNA, 1410 nt, Artificial Sequence
  derived and/or modified sequence opt4 from neuraminidase__InfluenzaA__ADF83766
augaaccccaaccagaagaucaucaccaucggcagcgugugcaugaccaucggcauggccaaccugauccugcagaucggcaacaucaucagcaucuggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacgacaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171132 - RNA, 1410 nt, Artificial Sequence; identical to SEQ ID NO: 169258
  derived and/or modified sequence opt4 from neuraminidase__InfluenzaA__ADF83776

SEQ ID NO: 171133 - RNA, 1410 nt, Artificial Sequence
  derived and/or modified sequence opt4 from neuraminidase__InfluenzaA__ADF83786
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacggcgacaccgugggcuggagcuggcccgacggcgccgagcugcccuucaccaucgacaaguga

SEQ ID NO: 171134 - RNA, 1410 nt, Artificial Sequence
  derived and/or modified sequence opt4 from neuraminidase__InfluenzaA__ADF83796
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugagaaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171135 - RNA, 1410 nt, Artificial Sequence; identical to SEQ ID NO: 169258
  derived and/or modified sequence opt4 from neuraminidase__InfluenzaA__ADF83806

SEQ ID NO: 171136 - RNA, 1410 nt, Artificial Sequence; identical to SEQ ID NO: 170771
  derived and/or modified sequence opt4 from neuraminidase__InfluenzaA__ADF83816

SEQ ID NO: 171137 - RNA, 1410 nt, Artificial Sequence; identical to SEQ ID NO: 169258
  derived and/or modified sequence opt4 from neuraminidase__InfluenzaA__ADF83826

SEQ ID NO: 171138 - RNA, 1410 nt, Artificial Sequence; identical to SEQ ID NO: 169258
  derived and/or modified sequence opt4 from neuraminidase__InfluenzaA__ADF83836

SEQ ID NO: 171139 - RNA, 1410 nt, Artificial Sequence; identical to SEQ ID NO: 169258
  derived and/or modified sequence opt4 from neuraminidase__InfluenzaA__ADF83846

SEQ ID NO: 171140 - RNA, 1410 nt, Artificial Sequence; identical to SEQ ID NO: 169258
  derived and/or modified sequence opt4 from neuraminidase__InfluenzaA__ADF83856

SEQ ID NO: 171141 - RNA, 1410 nt, Artificial Sequence; identical to SEQ ID NO: 170609
  derived and/or modified sequence opt4 from neuraminidase__InfluenzaA__ADF83866

SEQ ID NO: 171142 - RNA, 1410 nt, Artificial Sequence; identical to SEQ ID NO: 171039
  derived and/or modified sequence opt4 from neuraminidase__InfluenzaA__ADF83876

SEQ ID NO: 171143 - RNA, 1410 nt, Artificial Sequence; identical to SEQ ID NO: 170689
  derived and/or modified sequence opt4 from neuraminidase__InfluenzaA__ADF83888

SEQ ID NO: 171144 - RNA, 1410 nt, Artificial Sequence
  derived and/or modified sequence opt4 from neuraminidase__InfluenzaA__ADF83898
augaaccccaaccagaagaucaucaccaucggcagcgugugcaugaccaucggcauggccaaccugauccugcagaucggcaacaucaucagcaucuggaucagccaccccauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171145 - RNA, 1410 nt, Artificial Sequence; identical to SEQ ID NO: 169258
  derived and/or modified sequence opt4 from neuraminidase__InfluenzaA__ADF83908

SEQ ID NO: 171146 - RNA, 1410 nt, Artificial Sequence; identical to SEQ ID NO: 169258
  derived and/or modified sequence opt4 from neuraminidase__InfluenzaA__ADF83918

SEQ ID NO: 171147 - RNA, 1410 nt, Artificial Sequence; identical to SEQ ID NO: 169258
  derived and/or modified sequence opt4 from neuraminidase__InfluenzaA__ADF84444

SEQ ID NO: 171148 - RNA, 1410 nt, Artificial Sequence; identical to SEQ ID NO: 169258
  derived and/or modified sequence opt4 from neuraminidase__InfluenzaA__ADF84462

SEQ ID NO: 171149 - RNA, 1410 nt, Artificial Sequence
  derived and/or modified sequence opt4 from neuraminidase__InfluenzaA__ADF84472
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccgagcagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171150 - RNA, 1410 nt, Artificial Sequence
  derived and/or modified sequence opt4 from neuraminidase__InfluenzaA__ADF84482
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucgccaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugagcuggagcuggcccgacggcgccgagcugcccuucaccaucgacaaguga

SEQ ID NO: 171151 - RNA, 1410 nt, Artificial Sequence
  derived and/or modified sequence opt4 from neuraminidase__InfluenzaA__ADF84492
augaaccccaaccagaagaucaucaccaucggcagcgugugcaugaccaucggcauggccaaccugauccugcagaucggcaacaucaucagcaucuggaucagccacagcauccagcugggcaaccaggaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171152 - RNA, 1410 nt, Artificial Sequence; identical to SEQ ID NO: 170365
  derived and/or modified sequence opt4 from neuraminidase__InfluenzaA__ADF85020

SEQ ID NO: 171153 - RNA, 1410 nt, Artificial Sequence; identical to SEQ ID NO: 169258
  derived and/or modified sequence opt4 from neuraminidase__InfluenzaA__ADF87155

SEQ ID NO: 171154 - RNA, 1410 nt, Artificial Sequence
  derived and/or modified sequence opt4 from neuraminidase__InfluenzaA__ADF87165
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgacaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucgccaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171155 - RNA, 1410 nt, Artificial Sequence; identical to SEQ ID NO: 171149
  derived and/or modified sequence opt4 from neuraminidase__InfluenzaA__ADF87175

SEQ ID NO: 171156 - RNA, 1410 nt, Artificial Sequence; identical to SEQ ID NO: 169258
  derived and/or modified sequence opt4 from neuraminidase__InfluenzaA__ADF87185

SEQ ID NO: 171157 - RNA, 1410 nt, Artificial Sequence; identical to SEQ ID NO: 171149
  derived and/or modified sequence opt4 from neuraminidase__InfluenzaA__ADF87195

SEQ ID NO: 171158 - RNA, 1410 nt, Artificial Sequence; identical to SEQ ID NO: 169258
  derived and/or modified sequence opt4 from neuraminidase__InfluenzaA__ADF87205

SEQ ID NO: 171159 - RNA, 1410 nt, Artificial Sequence; identical to SEQ ID NO: 169258
  derived and/or modified sequence opt4 from neuraminidase__InfluenzaA__ADF87215

SEQ ID NO: 171160 - RNA, 1410 nt, Artificial Sequence
  derived and/or modified sequence opt4 from neuraminidase__InfluenzaA__ADF87235
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171161 - RNA, 1410 nt, Artificial Sequence; identical to SEQ ID NO: 171149
  derived and/or modified sequence opt4 from neuraminidase__InfluenzaA__ADF87245

SEQ ID NO: 171162 - RNA, 1410 nt, Artificial Sequence; identical to SEQ ID NO: 171149
  derived and/or modified sequence opt4 from neuraminidase__InfluenzaA__ADF87265

SEQ ID NO: 171163 - RNA, 1410 nt, Artificial Sequence
  derived and/or modified sequence opt4 from neuraminidase__InfluenzaA__ADF87285
augaaccccaaccagaagaucaucaccaucggcagcgugugcaugagcaucggcauggccaaccugauccugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171164 - RNA, 1410 nt, Artificial Sequence; identical to SEQ ID NO: 169258
  derived and/or modified sequence opt4 from neuraminidase__InfluenzaA__ADF87295

SEQ ID NO: 171165 - RNA, 1410 nt, Artificial Sequence; identical to SEQ ID NO: 169258
  derived and/or modified sequence opt4 from neuraminidase__InfluenzaA__ADF87305

SEQ ID NO: 171166 - RNA, 1410 nt, Artificial Sequence; identical to SEQ ID NO: 169258
  derived and/or modified sequence opt4 from neuraminidase__InfluenzaA__ADF87334

SEQ ID NO: 171167 - RNA, 1410 nt, Artificial Sequence; identical to SEQ ID NO: 169258
  derived and/or modified sequence opt4 from neuraminidase__InfluenzaA__ADF87344

SEQ ID NO: 171168 - RNA, 1410 nt, Artificial Sequence
  derived and/or modified sequence opt4 from neuraminidase__InfluenzaA__ADF87354
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacuacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171169 - RNA, 1410 nt, Artificial Sequence; identical to SEQ ID NO: 169841
  derived and/or modified sequence opt4 from neuraminidase__InfluenzaA__ADF87364

SEQ ID NO: 171170 - RNA, 1410 nt, Artificial Sequence; identical to SEQ ID NO: 169258
  derived and/or modified sequence opt4 from neuraminidase__InfluenzaA__ADF87374

SEQ ID NO: 171171 - RNA, 1410 nt, Artificial Sequence
  derived and/or modified sequence opt4 from neuraminidase__InfluenzaA__ADF87384
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171172 - RNA, 1410 nt, Artificial Sequence; identical to SEQ ID NO: 169258
  derived and/or modified sequence opt4 from neuraminidase__InfluenzaA__ADF97251

SEQ ID NO: 171173 - RNA, 1410 nt, Artificial Sequence; identical to SEQ ID NO: 170501
  derived and/or modified sequence opt4 from neuraminidase__InfluenzaA__ADF97252

SEQ ID NO: 171174 - RNA, 1410 nt, Artificial Sequence; identical to SEQ ID NO: 169258
  derived and/or modified sequence opt4 from neuraminidase__InfluenzaA__ADF97253

SEQ ID NO: 171175 - RNA, 1410 nt, Artificial Sequence; identical to SEQ ID NO: 169258
  derived and/or modified sequence opt4 from neuraminidase__InfluenzaA__ADF97254

SEQ ID NO: 171176 - RNA, 1410 nt, Artificial Sequence
  derived and/or modified sequence opt4 from neuraminidase__InfluenzaA__ADF97255
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaaccacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171177 - RNA, 1410 nt, Artificial Sequence; identical to SEQ ID NO: 169258
  derived and/or modified sequence opt4 from neuraminidase__InfluenzaA__ADF97256

SEQ ID NO: 171178 - RNA, 1410 nt, Artificial Sequence; identical to SEQ ID NO: 169258
  derived and/or modified sequence opt4 from neuraminidase__InfluenzaA__ADF97257

SEQ ID NO: 171179 - RNA, 1410 nt, Artificial Sequence; identical to SEQ ID NO: 169612
  derived and/or modified sequence opt4 from neuraminidase__InfluenzaA__ADF97837

SEQ ID NO: 171180 - RNA, 1410 nt, Artificial Sequence; identical to SEQ ID NO: 169258
  derived and/or modified sequence opt4 from neuraminidase__InfluenzaA__ADG08120

SEQ ID NO: 171181 - RNA, 1350 nt, Artificial Sequence
  derived and/or modified sequence opt4 from neuraminidase__InfluenzaA__ADG21408
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaaccugagccugugccccgugagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171182 - RNA, 1350 nt, Artificial Sequence; identical to SEQ ID NO: 169543
  derived and/or modified sequence opt4 from neuraminidase__InfluenzaA__ADG21409

SEQ ID NO: 171183 - RNA, 1350 nt, Artificial Sequence; identical to SEQ ID NO: 169543
  derived and/or modified sequence opt4 from neuraminidase__InfluenzaA__ADG21415

SEQ ID NO: 171184 - RNA, 1350 nt, Artificial Sequence; identical to SEQ ID NO: 169543
  derived and/or modified sequence opt4 from neuraminidase__InfluenzaA__ADG21417

SEQ ID NO: 171185 - RNA, 1350 nt, Artificial Sequence
  derived and/or modified sequence opt4 from neuraminidase__InfluenzaA__ADG21419
augaaccccaaccagaagaucaucaccaucggcagcaucugcauggugaucggcaucgugagccugaugcugcagaucggcaacaugaucagcaucugggugagccacagcauccagaccggcaaccagugccaggacgagagcaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171186 - RNA, 1350 nt, Artificial Sequence
  derived and/or modified sequence opt4 from neuraminidase__InfluenzaA__ADG21423
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacagcuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171187 - RNA, 1350 nt, Artificial Sequence
  derived and/or modified sequence opt4 from neuraminidase__InfluenzaA__ADG21424
augaaccccaaccagaagaucaucaccaucggcagcaucugcauggugaucggcaucgccagccugaugcugcagaucggcaacaugaucagcaucugggugagccacagcauccagaccggcaaccagugccaggacgagagcaucagcaacaccaaguuccugaccgagaaggccguggccagcgugacccuggccggcaacagcagccugugccccaucagcggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171188 - RNA, 1350 nt, Artificial Sequence
  derived and/or modified sequence opt4 from neuraminidase__InfluenzaA__ADG21426
augaaccccaaccagaagaucaucaccaucggcagcaucugcauggugaucggcaucgugagccugaugcugcagaucggcaacaugaucagcaucugggugagccacagcauccagaccgagaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugagacaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171189 - RNA, 1350 nt, Artificial Sequence
  derived and/or modified sequence opt4 from neuraminidase__InfluenzaA__ADG21428
augaaccccaaccagaagaucaucaccaucggcagcaucugcauggugaucggcaucgugagccugaugcugcagaucggcaacaugaucagcaucugggugagccaccccauccagaccggcaaccagugccaggacaagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacagcaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171190 - RNA, 1350 nt, Artificial Sequence; identical to SEQ ID NO: 169543
  derived and/or modified sequence opt4 from neuraminidase__InfluenzaA__ADG21430

SEQ ID NO: 171191 - RNA, 1350 nt, Artificial Sequence
  derived and/or modified sequence opt4 from neuraminidase__InfluenzaA__ADG21432
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucagauacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171192 - RNA, 1350 nt, Artificial Sequence
  derived and/or modified sequence opt4 from neuraminidase__InfluenzaA__ADG21438
augaaccccaaccagaagaucaucaccaucggcagcaucugcauggugaucggcaucgugagccugaugcugcagaucggcaacaugaucagcaucuggaucagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcagcggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171193 - RNA, 1350 nt, Artificial Sequence
  derived and/or modified sequence opt4 from neuraminidase__InfluenzaA__ADG21440
augaaccccaaccagaagaucaucaccaucggcagcaucugcauggugaucggcaucgccagccugaugcugcagaucggcaacaugaucagcaucugggugagccacagcauccagaccggcaaccagugccaggacgagagcaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171194 - RNA, 1350 nt, Artificial Sequence; identical to SEQ ID NO: 169543
  derived and/or modified sequence opt4 from neuraminidase__InfluenzaA__ADG21442

SEQ ID NO: 171195 - RNA, 1350 nt, Artificial Sequence
  derived and/or modified sequence opt4 from neuraminidase__InfluenzaA__ADG21444
augaaccccaaccagaagaucaucaccaucggcagcaucugcauggugaucggcaucgugagccugaugcugcagaucggcaacaugaucagcaucugggugagccacagcauccagaccggcaaccagugccaggacgagagcaucagcaacaccaaguuccugaccgagaaggccgugaccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccuggaucagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171196 - RNA, 1350 nt, Artificial Sequence; identical to SEQ ID NO: 169543
  derived and/or modified sequence opt4 from neuraminidase__InfluenzaA__ADG21446

SEQ ID NO: 171197 - RNA, 1350 nt, Artificial Sequence
  derived and/or modified sequence opt4 from neuraminidase__InfluenzaA__ADG21448
augaaccccaaccagaagaucaucaccaucggcagcaucugcauggugaucggcaucgugagccugaugcugcagaucggcaacaugaucagcaucugggugagccacagcauccagaccggcaaccagugccaggacgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccuggaucagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 171198 - RNA, 1350 nt, Artificial Sequence; identical to SEQ ID NO: 171197
  derived and/or modified sequence opt4 from neuraminidase__InfluenzaA__ADG21450

SEQ ID NO: 171199 - RNA, 1410 nt, Artificial Sequence; identical to SEQ ID NO: 169258
  derived and/or modified sequence opt4 from neuraminidase__InfluenzaA__ADG27797

SEQ ID NO: 171200 - RNA, 1410 nt, Artificial Sequence
  derived and/or modified sequence opt4 from neuraminidase__InfluenzaA__ADG27983
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaaccaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccaugggcuggagcuggcccgacggcgccgagcugcccuucaccaucgacaaguga

SEQ ID NO: 171201 - RNA, 1410 nt, Artificial Sequence; identical to SEQ ID NO: 169258
  derived and/or modified sequence opt4 from neuraminidase__InfluenzaA__ADG27989

SEQ ID NO: 171202 - RNA, 1410 nt, Artificial Sequence; identical to SEQ ID NO: 171200
  derived and/or modified sequence opt4 from neuraminidase__InfluenzaA__ADG27998

SEQ ID NO: 171203 - RNA, 1410 nt, Artificial Sequence; identical to SEQ ID NO: 169612
  derived and/or modified sequence opt4 from neuraminidase__InfluenzaA__ADG28013

SEQ ID NO: 171204 - RNA, 1410 nt, Artificial Sequence; identical to SEQ ID NO: 169258
  derived and/or modified sequence opt4 from neuraminidase__InfluenzaA__ADG42086

SEQ ID NO: 171205 - RNA, 1410 nt, Artificial Sequence; identical to SEQ ID NO: 169258
  derived and/or modified sequence opt4 from neuraminidase__InfluenzaA__ADG42096

SEQ ID NO: 171206 - RNA, 1410 nt, Artificial Sequence; identical to SEQ ID NO: 170835
  derived and/or modified sequence opt4 from neuraminidase__InfluenzaA__ADG42106

SEQ ID NO: 171207 - RNA, 1410 nt, Artificial Sequence; identical to SEQ ID NO: 169258
  derived and/or modified sequence opt4 from neuraminidase__InfluenzaA__ADG42116

SEQ ID NO: 171208 - RNA, 1410 nt, Artificial Sequence; identical to SEQ ID NO: 169258
  derived and/or modified sequence opt4 from neuraminidase__InfluenzaA__ADG42126

SEQ ID NO: 171209 - RNA, 1410 nt, Artificial Sequence; identical to SEQ ID NO: 169258
  derived and/or modified sequence opt4 from neuraminidase__InfluenzaA__ADG42136

SEQ ID NO: 171210 - RNA, 1410 nt, Artificial Sequence; identical to SEQ ID NO: 169841
  derived and/or modified sequence opt4 from neuraminidase__InfluenzaA__ADG42146

SEQ ID NO: 171211 - RNA, 1410 nt, Artificial Sequence; identical to SEQ ID NO: 169258
  derived and/or modified sequence opt4 from neuraminidase__InfluenzaA__ADG42156

SEQ ID NO: 171212 - RNA, 1410 nt, Artificial Sequence; identical to SEQ ID NO: 169258
  derived and/or modified sequence opt4 from neuraminidase__InfluenzaA__ADG42166

SEQ ID NO: 171213 - RNA, 1410 nt, Artificial Sequence; identical to SEQ ID NO: 169258
  derived and/or modified sequence opt4 from neuraminidase__InfluenzaA__ADG42186

SEQ ID NO: 171214 - RNA, 1410 nt, Artificial Sequence; identical to SEQ ID NO: 171149
  derived and/or modified sequence opt4 from neuraminidase__InfluenzaA__ADG42196

SEQ ID NO: 171215 - RNA, 1410 nt, Artificial Sequence
  derived and/or modified sequence opt4 from neuraminidase__InfluenzaA__ADG42206
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcaagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171216 - RNA, 1410 nt, Artificial Sequence; identical to SEQ ID NO: 169258
  derived and/or modified sequence opt4 from neuraminidase__InfluenzaA__ADG42216

SEQ ID NO: 171217 - RNA, 1410 nt, Artificial Sequence; identical to SEQ ID NO: 170609
  derived and/or modified sequence opt4 from neuraminidase__InfluenzaA__ADG42226

SEQ ID NO: 171218 - RNA, 1410 nt, Artificial Sequence; identical to SEQ ID NO: 169258
  derived and/or modified sequence opt4 from neuraminidase__InfluenzaA__ADG42236

SEQ ID NO: 171219 - RNA, 1410 nt, Artificial Sequence; identical to SEQ ID NO: 169258
  derived and/or modified sequence opt4 from neuraminidase__InfluenzaA__ADG42246

SEQ ID NO: 171220 - RNA, 1410 nt, Artificial Sequence; identical to SEQ ID NO: 169258
  derived and/or modified sequence opt4 from neuraminidase__InfluenzaA__ADG42256

SEQ ID NO: 171221 - RNA, 1410 nt, Artificial Sequence; identical to SEQ ID NO: 169258
  derived and/or modified sequence opt4 from neuraminidase__InfluenzaA__ADG42276

SEQ ID NO: 171222 - RNA, 1410 nt, Artificial Sequence
  derived and/or modified sequence opt4 from neuraminidase__InfluenzaA__ADG42296
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagagcccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171223 - RNA, 1410 nt, Artificial Sequence; identical to SEQ ID NO: 169258
  derived and/or modified sequence opt4 from neuraminidase__InfluenzaA__ADG42306

SEQ ID NO: 171224 - RNA, 1410 nt, Artificial Sequence; identical to SEQ ID NO: 169258
  derived and/or modified sequence opt4 from neuraminidase__InfluenzaA__ADG42316

SEQ ID NO: 171225 - RNA, 1410 nt, Artificial Sequence; identical to SEQ ID NO: 169258
  derived and/or modified sequence opt4 from neuraminidase__InfluenzaA__ADG42326

SEQ ID NO: 171226 - RNA, 1410 nt, Artificial Sequence
  derived and/or modified sequence opt4 from neuraminidase__InfluenzaA__ADG42336
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcaugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171227 - RNA, 1410 nt, Artificial Sequence; identical to SEQ ID NO: 170720
  derived and/or modified sequence opt4 from neuraminidase__InfluenzaA__ADG42346

SEQ ID NO: 171228 - RNA, 1410 nt, Artificial Sequence; identical to SEQ ID NO: 170435
  derived and/or modified sequence opt4 from neuraminidase__InfluenzaA__ADG42356

SEQ ID NO: 171229 - RNA, 1410 nt, Artificial Sequence
  derived and/or modified sequence opt4 from neuraminidase__InfluenzaA__ADG42366
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccuggaucagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171230 - RNA, 1410 nt, Artificial Sequence; identical to SEQ ID NO: 169258
  derived and/or modified sequence opt4 from neuraminidase__InfluenzaA__ADG42376

SEQ ID NO: 171231 - RNA, 1410 nt, Artificial Sequence
  derived and/or modified sequence opt4 from neuraminidase__InfluenzaA__ADG42386
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaaguucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccaacgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaagcggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171232 - RNA, 1410 nt, Artificial Sequence; identical to SEQ ID NO: 171215
  derived and/or modified sequence opt4 from neuraminidase__InfluenzaA__ADG42396

SEQ ID NO: 171233 - RNA, 1410 nt, Artificial Sequence
  derived and/or modified sequence opt4 from neuraminidase__InfluenzaA__ADG42406
augaaccccaaccagaagaucaucaccaucggcagcgugugcaugaccaucggcauggccaaccugauccugcagaucggcaacauccugagcaccuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171234 - RNA, 1410 nt, Artificial Sequence; identical to SEQ ID NO: 170435
  derived and/or modified sequence opt4 from neuraminidase__InfluenzaA__ADG42426

SEQ ID NO: 171235 - RNA, 1410 nt, Artificial Sequence; identical to SEQ ID NO: 169258
  derived and/or modified sequence opt4 from neuraminidase__InfluenzaA__ADG42436

SEQ ID NO: 171236 - RNA, 1410 nt, Artificial Sequence
  derived and/or modified sequence opt4 from neuraminidase__InfluenzaA__ADG42446
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgccaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171237 - RNA, 1410 nt, Artificial Sequence
  derived and/or modified sequence opt4 from neuraminidase__InfluenzaA__ADG42456
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171238 - RNA, 1410 nt, Artificial Sequence; identical to SEQ ID NO: 169258
  derived and/or modified sequence opt4 from neuraminidase__InfluenzaA__ADG42466

SEQ ID NO: 171239 - RNA, 1410 nt, Artificial Sequence
  derived and/or modified sequence opt4 from neuraminidase__InfluenzaA__ADG42476
augaaccccaaccagaagaucaucaccaucggcagcgugugcaugaccaucggcauggccaaccugauccugcagaucggcaacaucaucagcaucuggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171240 - RNA, 1410 nt, Artificial Sequence; identical to SEQ ID NO: 171160
  derived and/or modified sequence opt4 from neuraminidase__InfluenzaA__ADG42486

SEQ ID NO: 171241 - RNA, 1410 nt, Artificial Sequence; identical to SEQ ID NO: 169258
  derived and/or modified sequence opt4 from neuraminidase__InfluenzaA__ADG42496

SEQ ID NO: 171242 - RNA, 1410 nt, Artificial Sequence
  derived and/or modified sequence opt4 from neuraminidase__InfluenzaA__ADG42506
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagguggugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171243 - RNA, 1410 nt, Artificial Sequence; identical to SEQ ID NO: 170433
  derived and/or modified sequence opt4 from neuraminidase__InfluenzaA__ADG42516

SEQ ID NO: 171244 - RNA, 1410 nt, Artificial Sequence
  derived and/or modified sequence opt4 from neuraminidase__InfluenzaA__ADG42526
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugccugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171245 - RNA, 1410 nt, Artificial Sequence
  derived and/or modified sequence opt4 from neuraminidase__InfluenzaA__ADG42536
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaccagcgacaccgugggcuggagcuggcccgacggcgccgagcugcccuucaccaucgacaaguga

SEQ ID NO: 171246 - RNA, 1410 nt, Artificial Sequence; identical to SEQ ID NO: 169258
  derived and/or modified sequence opt4 from neuraminidase__InfluenzaA__ADG42546

SEQ ID NO: 171247 - RNA, 1410 nt, Artificial Sequence; identical to SEQ ID NO: 169258
  derived and/or modified sequence opt4 from neuraminidase__InfluenzaA__ADG42556

SEQ ID NO: 171248 - RNA, 1410 nt, Artificial Sequence
  derived and/or modified sequence opt4 from neuraminidase__InfluenzaA__ADG42566
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccacagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171249 - RNA, 1410 nt, Artificial Sequence
  derived and/or modified sequence opt4 from neuraminidase__InfluenzaA__ADG42576
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccuacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171250 - RNA, 1410 nt, Artificial Sequence; identical to SEQ ID NO: 169258
  derived and/or modified sequence opt4 from neuraminidase__InfluenzaA__ADG42586

SEQ ID NO: 171251 - RNA, 1410 nt, Artificial Sequence
  derived and/or modified sequence opt4 from neuraminidase__InfluenzaA__ADG42606
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuuccccaucgacaaguga

SEQ ID NO: 171252 - RNA, 1410 nt, Artificial Sequence
  derived and/or modified sequence opt4 from neuraminidase__InfluenzaA__ADG42616
augaacagcaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171253 - RNA, 1410 nt, Artificial Sequence; identical to SEQ ID NO: 169841
  derived and/or modified sequence opt4 from neuraminidase__InfluenzaA__ADG42626

SEQ ID NO: 171254 - RNA, 1410 nt, Artificial Sequence; identical to SEQ ID NO: 171239
  derived and/or modified sequence opt4 from neuraminidase__InfluenzaA__ADG42636

SEQ ID NO: 171255 - RNA, 1410 nt, Artificial Sequence
  derived and/or modified sequence opt4 from neuraminidase__InfluenzaA__ADG42646
augaaccccaaccagagaaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171256 - RNA, 1410 nt, Artificial Sequence; identical to SEQ ID NO: 169258
  derived and/or modified sequence opt4 from neuraminidase__InfluenzaA__ADG42656

SEQ ID NO: 171257 - RNA, 1410 nt, Artificial Sequence; identical to SEQ ID NO: 171171
  derived and/or modified sequence opt4 from neuraminidase__InfluenzaA__ADG42666

SEQ ID NO: 171258 - RNA, 1410 nt, Artificial Sequence
  derived and/or modified sequence opt4 from neuraminidase__InfluenzaA__ADG42676
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaucugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171259 - RNA, 1410 nt, Artificial Sequence; identical to SEQ ID NO: 169258
  derived and/or modified sequence opt4 from neuraminidase__InfluenzaA__ADG42686

SEQ ID NO: 171260 - RNA, 1410 nt, Artificial Sequence; identical to SEQ ID NO: 170835
  derived and/or modified sequence opt4 from neuraminidase__InfluenzaA__ADG42696

SEQ ID NO: 171261 - RNA, 1410 nt, Artificial Sequence; identical to SEQ ID NO: 171039
  derived and/or modified sequence opt4 from neuraminidase__InfluenzaA__ADG42706

SEQ ID NO: 171262 - RNA, 1410 nt, Artificial Sequence; identical to SEQ ID NO: 169258
  derived and/or modified sequence opt4 from neuraminidase__InfluenzaA__ADG42716

SEQ ID NO: 171263 - RNA, 1410 nt, Artificial Sequence; identical to SEQ ID NO: 170546
  derived and/or modified sequence opt4 from neuraminidase__InfluenzaA__ADG42726

SEQ ID NO: 171264 - RNA, 1410 nt, Artificial Sequence; identical to SEQ ID NO: 169841
  derived and/or modified sequence opt4 from neuraminidase__InfluenzaA__ADG42746

SEQ ID NO: 171265 - RNA, 1410 nt, Artificial Sequence; identical to SEQ ID NO: 170771
  derived and/or modified sequence opt4 from neuraminidase__InfluenzaA__ADG42756

SEQ ID NO: 171266 - RNA, 1410 nt, Artificial Sequence; identical to SEQ ID NO: 170546
  derived and/or modified sequence opt4 from neuraminidase__InfluenzaA__ADG42766

SEQ ID NO: 171267 - RNA, 1410 nt, Artificial Sequence; identical to SEQ ID NO: 170546
  derived and/or modified sequence opt4 from neuraminidase__InfluenzaA__ADG42776

SEQ ID NO: 171268 - RNA, 1410 nt, Artificial Sequence; identical to SEQ ID NO: 170546
  derived and/or modified sequence opt4 from neuraminidase__InfluenzaA__ADG42796

SEQ ID NO: 171269 - RNA, 1410 nt, Artificial Sequence
  derived and/or modified sequence opt4 from neuraminidase__InfluenzaA__ADG42806
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugagcuggagcuggcccgacggcgccgagcugcccuucaccaucgacaaguga

SEQ ID NO: 171270 - RNA, 1410 nt, Artificial Sequence; identical to SEQ ID NO: 169258
  derived and/or modified sequence opt4 from neuraminidase__InfluenzaA__ADG42816

SEQ ID NO: 171271 - RNA, 1410 nt, Artificial Sequence; identical to SEQ ID NO: 169258
  derived and/or modified sequence opt4 from neuraminidase__InfluenzaA__ADG42826

SEQ ID NO: 171272 - RNA, 1410 nt, Artificial Sequence; identical to SEQ ID NO: 169258
  derived and/or modified sequence opt4 from neuraminidase__InfluenzaA__ADG42836

SEQ ID NO: 171273 - RNA, 1410 nt, Artificial Sequence; identical to SEQ ID NO: 170874
  derived and/or modified sequence opt4 from neuraminidase__InfluenzaA__ADG42846

SEQ ID NO: 171274 - RNA, 1410 nt, Artificial Sequence; identical to SEQ ID NO: 169258
  derived and/or modified sequence opt4 from neuraminidase__InfluenzaA__ADG42856

SEQ ID NO: 171275 - RNA, 1410 nt, Artificial Sequence; identical to SEQ ID NO: 170870
  derived and/or modified sequence opt4 from neuraminidase__InfluenzaA__ADG42866

SEQ ID NO: 171276 - RNA, 1410 nt, Artificial Sequence; identical to SEQ ID NO: 169258
  derived and/or modified sequence opt4 from neuraminidase__InfluenzaA__ADG42876

SEQ ID NO: 171277 - RNA, 1410 nt, Artificial Sequence; identical to SEQ ID NO: 170907
  derived and/or modified sequence opt4 from neuraminidase__InfluenzaA__ADG42886

SEQ ID NO: 171278 - RNA, 1410 nt, Artificial Sequence; identical to SEQ ID NO: 170850
  derived and/or modified sequence opt4 from neuraminidase__InfluenzaA__ADG42896

SEQ ID NO: 171279 - RNA, 1410 nt, Artificial Sequence; identical to SEQ ID NO: 170850
  derived and/or modified sequence opt4 from neuraminidase__InfluenzaA__ADG42906

SEQ ID NO: 171280 - RNA, 1410 nt, Artificial Sequence; identical to SEQ ID NO: 169258
  derived and/or modified sequence opt4 from neuraminidase__InfluenzaA__ADG42916

SEQ ID NO: 171281 - RNA, 1410 nt, Artificial Sequence; identical to SEQ ID NO: 169258
  derived and/or modified sequence opt4 from neuraminidase__InfluenzaA__ADG42926

SEQ ID NO: 171282 - RNA, 1410 nt, Artificial Sequence; identical to SEQ ID NO: 169258
  derived and/or modified sequence opt4 from neuraminidase__InfluenzaA__ADG58909

SEQ ID NO: 171283 - RNA, 1410 nt, Artificial Sequence; identical to SEQ ID NO: 169258
  derived and/or modified sequence opt4 from neuraminidase__InfluenzaA__ADG58910

SEQ ID NO: 171284 - RNA, 1410 nt, Artificial Sequence
  derived and/or modified sequence opt4 from neuraminidase__InfluenzaA__ADG58913
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugaccuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggaucgagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171285 - RNA, 1410 nt, Artificial Sequence; identical to SEQ ID NO: 169258
  derived and/or modified sequence opt4 from neuraminidase__InfluenzaA__ADG58914

SEQ ID NO: 171286 - RNA, 1410 nt, Artificial Sequence; identical to SEQ ID NO: 169258
  derived and/or modified sequence opt4 from neuraminidase__InfluenzaA__ADG58916

SEQ ID NO: 171287 - RNA, 1410 nt, Artificial Sequence; identical to SEQ ID NO: 169258
  derived and/or modified sequence opt4 from neuraminidase__InfluenzaA__ADG58917

SEQ ID NO: 171288 - RNA, 1410 nt, Artificial Sequence
  derived and/or modified sequence opt4 from neuraminidase__InfluenzaA__ADG58918
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugaccuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171289 - RNA, 1410 nt, Artificial Sequence; identical to SEQ ID NO: 171284
  derived and/or modified sequence opt4 from neuraminidase__InfluenzaA__ADG58919

SEQ ID NO: 171290 - RNA, 1410 nt, Artificial Sequence; identical to SEQ ID NO: 169413
  derived and/or modified sequence opt4 from neuraminidase__InfluenzaA__ADG58920

SEQ ID NO: 171291 - RNA, 1410 nt, Artificial Sequence; identical to SEQ ID NO: 169413
  derived and/or modified sequence opt4 from neuraminidase__InfluenzaA__ADG58921

SEQ ID NO: 171292 - RNA, 1410 nt, Artificial Sequence; identical to SEQ ID NO: 169413
  derived and/or modified sequence opt4 from neuraminidase__InfluenzaA__ADG58922

SEQ ID NO: 171293 - RNA, 1410 nt, Artificial Sequence; identical to SEQ ID NO: 169413
  derived and/or modified sequence opt4 from neuraminidase__InfluenzaA__ADG58923

SEQ ID NO: 171294 - RNA, 1410 nt, Artificial Sequence; identical to SEQ ID NO: 169413
  derived and/or modified sequence opt4 from neuraminidase__InfluenzaA__ADG58924

SEQ ID NO: 171295 - RNA, 1410 nt, Artificial Sequence; identical to SEQ ID NO: 169413
  derived and/or modified sequence opt4 from neuraminidase__InfluenzaA__ADG58925

SEQ ID NO: 171296 - RNA, 1410 nt, Artificial Sequence; identical to SEQ ID NO: 169413
  derived and/or modified sequence opt4 from neuraminidase__InfluenzaA__ADG58926

SEQ ID NO: 171297 - RNA, 1410 nt, Artificial Sequence; identical to SEQ ID NO: 169413
  derived and/or modified sequence opt4 from neuraminidase__InfluenzaA__ADG58927

SEQ ID NO: 171298 - RNA, 1410 nt, Artificial Sequence; identical to SEQ ID NO: 170276
  derived and/or modified sequence opt4 from neuraminidase__InfluenzaA__ADG58928

SEQ ID NO: 171299 - RNA, 1410 nt, Artificial Sequence; identical to SEQ ID NO: 170276
  derived and/or modified sequence opt4 from neuraminidase__InfluenzaA__ADG58929

SEQ ID NO: 171300 - RNA, 1410 nt, Artificial Sequence
  derived and/or modified sequence opt4 from neuraminidase__InfluenzaA__ADG58931
augaaccccaaccagaagaucaucaccaucggcagcgugugcaugaccaucggcauggccaaccugauccugcagaucggcaacaccaucagcaucuggaucaaccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171301 - RNA, 1410 nt, Artificial Sequence; identical to SEQ ID NO: 171300
  derived and/or modified sequence opt4 from neuraminidase__InfluenzaA__ADG58932

SEQ ID NO: 171302 - RNA, 1410 nt, Artificial Sequence; identical to SEQ ID NO: 171300
  derived and/or modified sequence opt4 from neuraminidase__InfluenzaA__ADG58933

SEQ ID NO: 171303 - RNA, 1410 nt, Artificial Sequence; identical to SEQ ID NO: 171300
  derived and/or modified sequence opt4 from neuraminidase__InfluenzaA__ADG58934

SEQ ID NO: 171304 - RNA, 1410 nt, Artificial Sequence; identical to SEQ ID NO: 171300
  derived and/or modified sequence opt4 from neuraminidase__InfluenzaA__ADG58935

SEQ ID NO: 171305 - RNA, 1410 nt, Artificial Sequence; identical to SEQ ID NO: 171300
  derived and/or modified sequence opt4 from neuraminidase__InfluenzaA__ADG58936

SEQ ID NO: 171306 - RNA, 1410 nt, Artificial Sequence; identical to SEQ ID NO: 171300
  derived and/or modified sequence opt4 from neuraminidase__InfluenzaA__ADG58937

SEQ ID NO: 171307 - RNA, 1410 nt, Artificial Sequence; identical to SEQ ID NO: 171300
  derived and/or modified sequence opt4 from neuraminidase__InfluenzaA__ADG58938

SEQ ID NO: 171308 - RNA, 1410 nt, Artificial Sequence
  derived and/or modified sequence opt4 from neuraminidase__InfluenzaA__ADG59589
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccauggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagguggugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171309 - RNA, 1410 nt, Artificial Sequence; identical to SEQ ID NO: 169258
  derived and/or modified sequence opt4 from neuraminidase__InfluenzaA__ADG59590

SEQ ID NO: 171310 - RNA, 1410 nt, Artificial Sequence; identical to SEQ ID NO: 169258
  derived and/or modified sequence opt4 from neuraminidase__InfluenzaA__ADG59591

SEQ ID NO: 171311 - RNA, 1410 nt, Artificial Sequence; identical to SEQ ID NO: 169258
  derived and/or modified sequence opt4 from neuraminidase__InfluenzaA__ADG59592

SEQ ID NO: 171312 - RNA, 1410 nt, Artificial Sequence; identical to SEQ ID NO: 171160
  derived and/or modified sequence opt4 from neuraminidase__InfluenzaA__ADG59593

SEQ ID NO: 171313 - RNA, 1410 nt, Artificial Sequence; identical to SEQ ID NO: 170435
  derived and/or modified sequence opt4 from neuraminidase__InfluenzaA__ADG59594

SEQ ID NO: 171314 - RNA, 1410 nt, Artificial Sequence; identical to SEQ ID NO: 170435
  derived and/or modified sequence opt4 from neuraminidase__InfluenzaA__ADG59595

SEQ ID NO: 171315 - RNA, 1410 nt, Artificial Sequence
  derived and/or modified sequence opt4 from neuraminidase__InfluenzaA__ADG59596
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacagaaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171316 - RNA, 1410 nt, Artificial Sequence; identical to SEQ ID NO: 169258
  derived and/or modified sequence opt4 from neuraminidase__InfluenzaA__ADG59597

SEQ ID NO: 171317 - RNA, 1410 nt, Artificial Sequence; identical to SEQ ID NO: 169258
  derived and/or modified sequence opt4 from neuraminidase__InfluenzaA__ADG59598

SEQ ID NO: 171318 - RNA, 1410 nt, Artificial Sequence; identical to SEQ ID NO: 170433
  derived and/or modified sequence opt4 from neuraminidase__InfluenzaA__ADG59599

SEQ ID NO: 171319 - RNA, 1410 nt, Artificial Sequence; identical to SEQ ID NO: 169258
  derived and/or modified sequence opt4 from neuraminidase__InfluenzaA__ADG59601

SEQ ID NO: 171320 - RNA, 1410 nt, Artificial Sequence; identical to SEQ ID NO: 171160
  derived and/or modified sequence opt4 from neuraminidase__InfluenzaA__ADG59602

SEQ ID NO: 171321 - RNA, 1410 nt, Artificial Sequence; identical to SEQ ID NO: 171160
  derived and/or modified sequence opt4 from neuraminidase__InfluenzaA__ADG59603

SEQ ID NO: 171322 - RNA, 1410 nt, Artificial Sequence; identical to SEQ ID NO: 169258
  derived and/or modified sequence opt4 from neuraminidase__InfluenzaA__ADG59604

SEQ ID NO: 171323 - RNA, 1410 nt, Artificial Sequence; identical to SEQ ID NO: 169258
  derived and/or modified sequence opt4 from neuraminidase__InfluenzaA__ADG59605

SEQ ID NO: 171324 - RNA, 1410 nt, Artificial Sequence; identical to SEQ ID NO: 170276
  derived and/or modified sequence opt4 from neuraminidase__InfluenzaA__ADG59606

SEQ ID NO: 171325 - RNA, 1410 nt, Artificial Sequence; identical to SEQ ID NO: 169258
  derived and/or modified sequence opt4 from neuraminidase__InfluenzaA__ADG59607

SEQ ID NO: 171326 - RNA, 1410 nt, Artificial Sequence; identical to SEQ ID NO: 169258
  derived and/or modified sequence opt4 from neuraminidase__InfluenzaA__ADG59608

SEQ ID NO: 171327 - RNA, 1410 nt, Artificial Sequence; identical to SEQ ID NO: 170079
  derived and/or modified sequence opt4 from neuraminidase__InfluenzaA__ADG59609

SEQ ID NO: 171328 - RNA, 1410 nt, Artificial Sequence; identical to SEQ ID NO: 171160
  derived and/or modified sequence opt4 from neuraminidase__InfluenzaA__ADG59610

SEQ ID NO: 171329 - RNA, 1410 nt, Artificial Sequence; identical to SEQ ID NO: 170276
  derived and/or modified sequence opt4 from neuraminidase__InfluenzaA__ADG59611

SEQ ID NO: 171330 - RNA, 1410 nt, Artificial Sequence; identical to SEQ ID NO: 171160
  derived and/or modified sequence opt4 from neuraminidase__InfluenzaA__ADG59612

SEQ ID NO: 171331 - RNA, 1410 nt, Artificial Sequence
  derived and/or modified sequence opt4 from neuraminidase__InfluenzaA__ADG59613
augaaccccaaccagaagaucaucaccaucggcagcgugugcaugaccaucggcaugaccaaccugauccugcagcugggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 171332 - RNA, 1410 nt, Artificial Sequence; identical to SEQ ID NO: 170433
  derived and/or modified sequence opt4 from neuraminidase__InfluenzaA__ADG59614

SEQ ID NO: 171333 - RNA, 1410 nt, Artificial Sequence; identical to SEQ ID NO: 169258
  derived and/or modified sequence opt4 from neuraminidase__InfluenzaA__ADH01811

SEQ ID NO: 171334 - RNA, 1410 nt, Artificial Sequence; identical to SEQ ID NO: 169258
  derived and/or modified sequence opt4 from neuraminidase__InfluenzaA__ADH01821

SEQ ID NO: 171335 - RNA, 1410 nt, Artificial Sequence; identical to SEQ ID NO: 169258
  derived and/or modified sequence opt4 from neuraminidase__InfluenzaA__ADH01831

SEQ ID NO: 171336 - RNA, 1410 nt, Artificial Sequence; identical to SEQ ID NO: 169258
  derived and/or modified sequence opt4 from neuraminidase__InfluenzaA__ADH01841

SEQ ID NO: 171337 - RNA, 1410 nt, Artificial Sequence; identical to SEQ ID NO: 169258
  derived and/or modified sequence opt4 from neuraminidase__InfluenzaA__ADH01851

SEQ ID NO: 171338 - RNA, 1410 nt, Artificial Sequence; identical to SEQ ID NO: 169258
  derived and/or modified sequence opt4 from neuraminidase__InfluenzaA__ADH01861

SEQ ID NO: 171339 - RNA, 1410 nt, Artificial Sequence; identical to SEQ ID NO: 169258
  derived and/or modified sequence opt4 from neuraminidase__InfluenzaA__ADH01871

SEQ ID NO: 171340 - RNA, 1410 nt, Artificial Sequence; identical to SEQ ID NO: 169258
  derived and/or modified sequence opt4 from neuraminidase__InfluenzaA__ADH01881

SEQ ID NO: 171341 - RNA, 1410 nt, Artificial Sequence; identical to SEQ ID NO: 169258
  derived and/or modified sequence opt4 from neuraminidase__InfluenzaA__ADH01891

SEQ ID NO: 171342 - RNA, 1410 nt, Artificial Sequence; identical to SEQ ID NO: 169258
  derived and/or modified sequence opt4 from neuraminidase__InfluenzaA__ADH01901

SEQ ID NO: 171343 - RNA, 1410 nt, Artificial Sequence; identical to SEQ ID NO: 169258
  derived and/or modified sequence opt4 from neuraminidase__InfluenzaA__ADH01911

SEQ ID NO: 171344 - RNA, 1410 nt, Artificial Sequence; identical to SEQ ID NO: 169258
  derived and/or modified sequence opt4 from neuraminidase__InfluenzaA__ADH01921

SEQ ID NO: 171345 - RNA, 1410 nt, Artificial Sequence; identical to SEQ ID NO: 169258
  derived and/or modified sequence opt4 from neuraminidase__InfluenzaA__ADH01931

SEQ ID NO: 171346 - RNA, 1410 nt, Artificial Sequence; identical to SEQ ID NO: 171149
  derived and/or modified sequence opt4 from neuraminidase__InfluenzaA__ADH01941

SEQ ID NO: 171347 - RNA, 1410 nt, Artificial Sequence; identical to SEQ ID NO: 169258
  derived and/or modified sequence opt4 from neuraminidase__InfluenzaA__ADH01951

SEQ ID NO: 171348 - RNA, 1410 nt, Artificial Sequence; identical to SEQ ID NO: 169258
  derived and/or modified sequence opt4 from neuraminidase__InfluenzaA__ADH01961

SEQ ID NO: 171349 - RNA, 1410 nt, Artificial Sequence
  derived and/or modified sequence opt4 from neuraminidase__InfluenzaA__ADH01981
augaaccccaaccagaagaucaucaccaucggcagcgccugcaugaccaucggcauggccaaccugauccugcagaucggcaacaucaucagcaucuggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171350 - RNA, 1410 nt, Artificial Sequence; identical to SEQ ID NO: 170546
  derived and/or modified sequence opt4 from neuraminidase__InfluenzaA__ADH01991

SEQ ID NO: 171351 - RNA, 1410 nt, Artificial Sequence; identical to SEQ ID NO: 171215
  derived and/or modified sequence opt4 from neuraminidase__InfluenzaA__ADH02011

SEQ ID NO: 171352 - RNA, 1410 nt, Artificial Sequence; identical to SEQ ID NO: 170435
  derived and/or modified sequence opt4 from neuraminidase__InfluenzaA__ADH02021

SEQ ID NO: 171353 - RNA, 1410 nt, Artificial Sequence; identical to SEQ ID NO: 169258
  derived and/or modified sequence opt4 from neuraminidase__InfluenzaA__ADI24510

SEQ ID NO: 171354 - RNA, 1410 nt, Artificial Sequence; identical to SEQ ID NO: 169258
  derived and/or modified sequence opt4 from neuraminidase__InfluenzaA__ADI24516

SEQ ID NO: 171355 - RNA, 1410 nt, Artificial Sequence; identical to SEQ ID NO: 169258
  derived and/or modified sequence opt4 from neuraminidase__InfluenzaA__ADI24518

SEQ ID NO: 171356 - RNA, 1410 nt, Artificial Sequence; identical to SEQ ID NO: 169258
  derived and/or modified sequence opt4 from neuraminidase__InfluenzaA__ADI24522

SEQ ID NO: 171357 - RNA, 1410 nt, Artificial Sequence; identical to SEQ ID NO: 169258
  derived and/or modified sequence opt4 from neuraminidase__InfluenzaA__ADI24524

SEQ ID NO: 171358 - RNA, 1410 nt, Artificial Sequence; identical to SEQ ID NO: 169258
  derived and/or modified sequence opt4 from neuraminidase__InfluenzaA__ADI24526

SEQ ID NO: 171359 - RNA, 1410 nt, Artificial Sequence; identical to SEQ ID NO: 169258
  derived and/or modified sequence opt4 from neuraminidase__InfluenzaA__ADI24528

SEQ ID NO: 171360 - RNA, 1410 nt, Artificial Sequence; identical to SEQ ID NO: 169258
  derived and/or modified sequence opt4 from neuraminidase__InfluenzaA__ADI24530

SEQ ID NO: 171361 - RNA, 1410 nt, Artificial Sequence
  derived and/or modified sequence opt4 from neuraminidase__InfluenzaA__ADI24532
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcagcggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171362 - RNA, 1410 nt, Artificial Sequence; identical to SEQ ID NO: 169258
  derived and/or modified sequence opt4 from neuraminidase__InfluenzaA__ADI24538

SEQ ID NO: 171363 - RNA, 1410 nt, Artificial Sequence; identical to SEQ ID NO: 169258
  derived and/or modified sequence opt4 from neuraminidase__InfluenzaA__ADI24548

SEQ ID NO: 171364 - RNA, 1410 nt, Artificial Sequence; identical to SEQ ID NO: 169258
  derived and/or modified sequence opt4 from neuraminidase__InfluenzaA__ADI24556

SEQ ID NO: 171365 - RNA, 1410 nt, Artificial Sequence; identical to SEQ ID NO: 169258
  derived and/or modified sequence opt4 from neuraminidase__InfluenzaA__ADI24558

SEQ ID NO: 171366 - RNA, 1410 nt, Artificial Sequence; identical to SEQ ID NO: 169258
  derived and/or modified sequence opt4 from neuraminidase__InfluenzaA__ADI24560

SEQ ID NO: 171367 - RNA, 1410 nt, Artificial Sequence; identical to SEQ ID NO: 169258
  derived and/or modified sequence opt4 from neuraminidase__InfluenzaA__ADI24562

SEQ ID NO: 171368 - RNA, 1410 nt, Artificial Sequence; identical to SEQ ID NO: 169258
  derived and/or modified sequence opt4 from neuraminidase__InfluenzaA__ADI24564

SEQ ID NO: 171369 - RNA, 1410 nt, Artificial Sequence; identical to SEQ ID NO: 169258
  derived and/or modified sequence opt4 from neuraminidase__InfluenzaA__ADI24566

SEQ ID NO: 171370 - RNA, 1410 nt, Artificial Sequence; identical to SEQ ID NO: 169258
  derived and/or modified sequence opt4 from neuraminidase__InfluenzaA__ADI24568

SEQ ID NO: 171371 - RNA, 1410 nt, Artificial Sequence; identical to SEQ ID NO: 169258
  derived and/or modified sequence opt4 from neuraminidase__InfluenzaA__ADI24570

SEQ ID NO: 171372 - RNA, 1410 nt, Artificial Sequence; identical to SEQ ID NO: 169258
  derived and/or modified sequence opt4 from neuraminidase__InfluenzaA__ADI24572

SEQ ID NO: 171373 - RNA, 1410 nt, Artificial Sequence; identical to SEQ ID NO: 169258
  derived and/or modified sequence opt4 from neuraminidase__InfluenzaA__ADI24574

SEQ ID NO: 171374 - RNA, 1410 nt, Artificial Sequence; identical to SEQ ID NO: 169258
  derived and/or modified sequence opt4 from neuraminidase__InfluenzaA__ADI24576

SEQ ID NO: 171375 - RNA, 1410 nt, Artificial Sequence; identical to SEQ ID NO: 169258
  derived and/or modified sequence opt4 from neuraminidase__InfluenzaA__ADI24580

SEQ ID NO: 171376 - RNA, 1410 nt, Artificial Sequence; identical to SEQ ID NO: 170433
  derived and/or modified sequence opt4 from neuraminidase__InfluenzaA__ADI24582

SEQ ID NO: 171377 - RNA, 1410 nt, Artificial Sequence
  derived and/or modified sequence opt4 from neuraminidase__InfluenzaA__ADI24584
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171378 - RNA, 1410 nt, Artificial Sequence; identical to SEQ ID NO: 169612
  derived and/or modified sequence opt4 from neuraminidase__InfluenzaA__ADI24592

SEQ ID NO: 171379 - RNA, 1410 nt, Artificial Sequence; identical to SEQ ID NO: 169258
  derived and/or modified sequence opt4 from neuraminidase__InfluenzaA__ADI24598

SEQ ID NO: 171380 - RNA, 1410 nt, Artificial Sequence; identical to SEQ ID NO: 169258
  derived and/or modified sequence opt4 from neuraminidase__InfluenzaA__ADI24604

SEQ ID NO: 171381 - RNA, 1410 nt, Artificial Sequence; identical to SEQ ID NO: 169258
  derived and/or modified sequence opt4 from neuraminidase__InfluenzaA__ADI24620

SEQ ID NO: 171382 - RNA, 1410 nt, Artificial Sequence; identical to SEQ ID NO: 169258
  derived and/or modified sequence opt4 from neuraminidase__InfluenzaA__ADI24622

SEQ ID NO: 171383 - RNA, 1410 nt, Artificial Sequence; identical to SEQ ID NO: 169612
  derived and/or modified sequence opt4 from neuraminidase__InfluenzaA__ADI46780

SEQ ID NO: 171384 - RNA, 1410 nt, Artificial Sequence
  derived and/or modified sequence opt4 from neuraminidase__InfluenzaA__ADI46789
augaaccccaaccagaagaucaucaccaucggcagcgugugcaugaccaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacgagcaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171385 - RNA, 1410 nt, Artificial Sequence; identical to SEQ ID NO: 169258
  derived and/or modified sequence opt4 from neuraminidase__InfluenzaA__ADI48185

SEQ ID NO: 171386 - RNA, 1410 nt, Artificial Sequence; identical to SEQ ID NO: 169258
  derived and/or modified sequence opt4 from neuraminidase__InfluenzaA__ADI48187

SEQ ID NO: 171387 - RNA, 1410 nt, Artificial Sequence; identical to SEQ ID NO: 169258
  derived and/or modified sequence opt4 from neuraminidase__InfluenzaA__ADI48189

SEQ ID NO: 171388 - RNA, 1410 nt, Artificial Sequence; identical to SEQ ID NO: 169258
  derived and/or modified sequence opt4 from neuraminidase__InfluenzaA__ADI48191

SEQ ID NO: 171389 - RNA, 1410 nt, Artificial Sequence; identical to SEQ ID NO: 169258
  derived and/or modified sequence opt4 from neuraminidase__InfluenzaA__ADI48193

SEQ ID NO: 171390 - RNA, 1410 nt, Artificial Sequence; identical to SEQ ID NO: 169258
  derived and/or modified sequence opt4 from neuraminidase__InfluenzaA__ADI48195

SEQ ID NO: 171391 - RNA, 1410 nt, Artificial Sequence
  derived and/or modified sequence opt4 from neuraminidase__InfluenzaA__ADI48197
augaaccccaaccagaagaucaucaccaucggcagcgugugcaugaccaucggcauggccaaccugauccugcagaucggcaacaucaucagcaucuggaucagccacagcauccaguucggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171392 - RNA, 1410 nt, Artificial Sequence; identical to SEQ ID NO: 169258
  derived and/or modified sequence opt4 from neuraminidase__InfluenzaA__ADI48199

SEQ ID NO: 171393 - RNA, 1410 nt, Artificial Sequence; identical to SEQ ID NO: 169258
  derived and/or modified sequence opt4 from neuraminidase__InfluenzaA__ADI48201

SEQ ID NO: 171394 - RNA, 1410 nt, Artificial Sequence; identical to SEQ ID NO: 169258
  derived and/or modified sequence opt4 from neuraminidase__InfluenzaA__ADI48203

SEQ ID NO: 171395 - RNA, 1410 nt, Artificial Sequence
  derived and/or modified sequence opt4 from neuraminidase__InfluenzaA__ADI48205
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171396 - RNA, 1410 nt, Artificial Sequence; identical to SEQ ID NO: 169258
  derived and/or modified sequence opt4 from neuraminidase__InfluenzaA__ADI48207

SEQ ID NO: 171397 - RNA, 1410 nt, Artificial Sequence; identical to SEQ ID NO: 169258
  derived and/or modified sequence opt4 from neuraminidase__InfluenzaA__ADI48209

SEQ ID NO: 171398 - RNA, 1410 nt, Artificial Sequence; identical to SEQ ID NO: 169258
  derived and/or modified sequence opt4 from neuraminidase__InfluenzaA__ADI48211

SEQ ID NO: 171399 - RNA, 1410 nt, Artificial Sequence; identical to SEQ ID NO: 169258
  derived and/or modified sequence opt4 from neuraminidase__InfluenzaA__ADI48213

SEQ ID NO: 171400 - RNA, 1410 nt, Artificial Sequence; identical to SEQ ID NO: 169258
  derived and/or modified sequence opt4 from neuraminidase__InfluenzaA__ADI48215

SEQ ID NO: 171401 - RNA, 1410 nt, Artificial Sequence; identical to SEQ ID NO: 169258
  derived and/or modified sequence opt4 from neuraminidase__InfluenzaA__ADI48217

SEQ ID NO: 171402 - RNA, 1410 nt, Artificial Sequence; identical to SEQ ID NO: 169258
  derived and/or modified sequence opt4 from neuraminidase__InfluenzaA__ADI48219

SEQ ID NO: 171403 - RNA, 1410 nt, Artificial Sequence; identical to SEQ ID NO: 169258
  derived and/or modified sequence opt4 from neuraminidase__InfluenzaA__ADI48221

SEQ ID NO: 171404 - RNA, 1410 nt, Artificial Sequence; identical to SEQ ID NO: 169258
  derived and/or modified sequence opt4 from neuraminidase__InfluenzaA__ADI48625

SEQ ID NO: 171405 - RNA, 1410 nt, Artificial Sequence; identical to SEQ ID NO: 169258
  derived and/or modified sequence opt4 from neuraminidase__InfluenzaA__ADI48635

SEQ ID NO: 171406 - RNA, 1410 nt, Artificial Sequence; identical to SEQ ID NO: 169258
  derived and/or modified sequence opt4 from neuraminidase__InfluenzaA__ADI48655

SEQ ID NO: 171407 - RNA, 1410 nt, Artificial Sequence; identical to SEQ ID NO: 169258
  derived and/or modified sequence opt4 from neuraminidase__InfluenzaA__ADI48665

SEQ ID NO: 171408 - RNA, 1410 nt, Artificial Sequence
  derived and/or modified sequence opt4 from neuraminidase__InfluenzaA__ADI48675
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacugaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171409 - RNA, 1410 nt, Artificial Sequence
  derived and/or modified sequence opt4 from neuraminidase__InfluenzaA__ADI48685
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcgccugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171410 - RNA, 1410 nt, Artificial Sequence; identical to SEQ ID NO: 169258
  derived and/or modified sequence opt4 from neuraminidase__InfluenzaA__ADI48695

SEQ ID NO: 171411 - RNA, 1410 nt, Artificial Sequence; identical to SEQ ID NO: 169248
  derived and/or modified sequence opt4 from neuraminidase__InfluenzaA__ADI48705

SEQ ID NO: 171412 - RNA, 1410 nt, Artificial Sequence; identical to SEQ ID NO: 169258
  derived and/or modified sequence opt4 from neuraminidase__InfluenzaA__ADI48715

SEQ ID NO: 171413 - RNA, 1410 nt, Artificial Sequence; identical to SEQ ID NO: 169258
  derived and/or modified sequence opt4 from neuraminidase__InfluenzaA__ADI48725

SEQ ID NO: 171414 - RNA, 1410 nt, Artificial Sequence; identical to SEQ ID NO: 169258
  derived and/or modified sequence opt4 from neuraminidase__InfluenzaA__ADI48735

SEQ ID NO: 171415 - RNA, 1410 nt, Artificial Sequence; identical to SEQ ID NO: 169258
  derived and/or modified sequence opt4 from neuraminidase__InfluenzaA__ADI48745

SEQ ID NO: 171416 - RNA, 1410 nt, Artificial Sequence
  derived and/or modified sequence opt4 from neuraminidase__InfluenzaA__ADI48755
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucagcgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171417 - RNA, 1410 nt, Artificial Sequence; identical to SEQ ID NO: 169258
  derived and/or modified sequence opt4 from neuraminidase__InfluenzaA__ADI48765

SEQ ID NO: 171418 - RNA, 1410 nt, Artificial Sequence; identical to SEQ ID NO: 169258
  derived and/or modified sequence opt4 from neuraminidase__InfluenzaA__ADI48775

SEQ ID NO: 171419 - RNA, 1410 nt, Artificial Sequence; identical to SEQ ID NO: 169258
  derived and/or modified sequence opt4 from neuraminidase__InfluenzaA__ADI48785

SEQ ID NO: 171420 - RNA, 1410 nt, Artificial Sequence; identical to SEQ ID NO: 169258
  derived and/or modified sequence opt4 from neuraminidase__InfluenzaA__ADI48795

SEQ ID NO: 171421 - RNA, 1410 nt, Artificial Sequence; identical to SEQ ID NO: 169258
  derived and/or modified sequence opt4 from neuraminidase__InfluenzaA__ADI49032

SEQ ID NO: 171422 - RNA, 1410 nt, Artificial Sequence; identical to SEQ ID NO: 169258
  derived and/or modified sequence opt4 from neuraminidase__InfluenzaA__ADI49243

SEQ ID NO: 171423 - RNA, 1410 nt, Artificial Sequence; identical to SEQ ID NO: 169258
  derived and/or modified sequence opt4 from neuraminidase__InfluenzaA__ADI49263

SEQ ID NO: 171424 - RNA, 1410 nt, Artificial Sequence; identical to SEQ ID NO: 169258
  derived and/or modified sequence opt4 from neuraminidase__InfluenzaA__ADI49273

SEQ ID NO: 171425 - RNA, 1410 nt, Artificial Sequence; identical to SEQ ID NO: 169258
  derived and/or modified sequence opt4 from neuraminidase__InfluenzaA__ADI49283

SEQ ID NO: 171426 - RNA, 1410 nt, Artificial Sequence; identical to SEQ ID NO: 169258
  derived and/or modified sequence opt4 from neuraminidase__InfluenzaA__ADI49315

SEQ ID NO: 171427 - RNA, 1410 nt, Artificial Sequence; identical to SEQ ID NO: 169258
  derived and/or modified sequence opt4 from neuraminidase__InfluenzaA__ADI49325

SEQ ID NO: 171428 - RNA, 1410 nt, Artificial Sequence; identical to SEQ ID NO: 169258
  derived and/or modified sequence opt4 from neuraminidase__InfluenzaA__ADI49335

SEQ ID NO: 171429 - RNA, 1410 nt, Artificial Sequence
  derived and/or modified sequence opt4 from neuraminidase__InfluenzaA__ADI49345
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaaccuggccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgacgugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171430 - RNA, 1410 nt, Artificial Sequence; identical to SEQ ID NO: 169258
  derived and/or modified sequence opt4 from neuraminidase__InfluenzaA__ADI49355

SEQ ID NO: 171431 - RNA, 1410 nt, Artificial Sequence; identical to SEQ ID NO: 169258
  derived and/or modified sequence opt4 from neuraminidase__InfluenzaA__ADI49365

SEQ ID NO: 171432 - RNA, 1410 nt, Artificial Sequence; identical to SEQ ID NO: 169258
  derived and/or modified sequence opt4 from neuraminidase__InfluenzaA__ADI49375

SEQ ID NO: 171433 - RNA, 1410 nt, Artificial Sequence; identical to SEQ ID NO: 169258
  derived and/or modified sequence opt4 from neuraminidase__InfluenzaA__ADI49385

SEQ ID NO: 171434 - RNA, 1410 nt, Artificial Sequence
  derived and/or modified sequence opt4 from neuraminidase__InfluenzaA__ADI49395
augaaccccaaccagaagaucaucaccaucggcagcgugugcaugaccaucggcauggccaaccugauccugcagaucggcaacaugaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagcugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171435 - RNA, 1410 nt, Artificial Sequence; identical to SEQ ID NO: 169258
  derived and/or modified sequence opt4 from neuraminidase__InfluenzaA__ADI49720

SEQ ID NO: 171436 - RNA, 1410 nt, Artificial Sequence; identical to SEQ ID NO: 169258
  derived and/or modified sequence opt4 from neuraminidase__InfluenzaA__ADI49730

SEQ ID NO: 171437 - RNA, 1410 nt, Artificial Sequence; identical to SEQ ID NO: 169258
  derived and/or modified sequence opt4 from neuraminidase__InfluenzaA__ADI49740

SEQ ID NO: 171438 - RNA, 1410 nt, Artificial Sequence; identical to SEQ ID NO: 169258
  derived and/or modified sequence opt4 from neuraminidase__InfluenzaA__ADI49750

SEQ ID NO: 171439 - RNA, 1410 nt, Artificial Sequence; identical to SEQ ID NO: 169258
  derived and/or modified sequence opt4 from neuraminidase__InfluenzaA__ADI49760

SEQ ID NO: 171440 - RNA, 1410 nt, Artificial Sequence; identical to SEQ ID NO: 169288
  derived and/or modified sequence opt4 from neuraminidase__InfluenzaA__ADI49780

SEQ ID NO: 171441 - RNA, 1410 nt, Artificial Sequence; identical to SEQ ID NO: 169248
  derived and/or modified sequence opt4 from neuraminidase__InfluenzaA__ADI49790

SEQ ID NO: 171442 - RNA, 1410 nt, Artificial Sequence; identical to SEQ ID NO: 169258
  derived and/or modified sequence opt4 from neuraminidase__InfluenzaA__ADI49821

SEQ ID NO: 171443 - RNA, 1410 nt, Artificial Sequence; identical to SEQ ID NO: 169248
  derived and/or modified sequence opt4 from neuraminidase__InfluenzaA__ADI50029

SEQ ID NO: 171444 - RNA, 1410 nt, Artificial Sequence
  derived and/or modified sequence opt4 from neuraminidase__InfluenzaA__ADI52830
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgacgagcugcccuucaccaucgacaaguga

SEQ ID NO: 171445 - RNA, 1410 nt, Artificial Sequence
  derived and/or modified sequence opt4 from neuraminidase__InfluenzaA__ADI52831
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcgugagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171446 - RNA, 1410 nt, Artificial Sequence; identical to SEQ ID NO: 169258
  derived and/or modified sequence opt4 from neuraminidase__InfluenzaA__ADI52832

SEQ ID NO: 171447 - RNA, 1410 nt, Artificial Sequence
  derived and/or modified sequence opt4 from neuraminidase__InfluenzaA__ADI52833
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggcccccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171448 - RNA, 1413 nt, Artificial Sequence; identical to SEQ ID NO: 169981
  derived and/or modified sequence opt4 from neuraminidase__InfluenzaA__ADI75821

SEQ ID NO: 171449 - RNA, 1410 nt, Artificial Sequence; identical to SEQ ID NO: 170425
  derived and/or modified sequence opt4 from neuraminidase__InfluenzaA__ADI75832

SEQ ID NO: 171450 - RNA, 1413 nt, Artificial Sequence
  derived and/or modified sequence opt4 from neuraminidase__InfluenzaA__ADI75854
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171451 - RNA, 1410 nt, Artificial Sequence
  derived and/or modified sequence opt4 from neuraminidase__InfluenzaA__ADI75876
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggaggugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcguggugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 171452 - RNA, 1410 nt, Artificial Sequence; identical to SEQ ID NO: 170425
  derived and/or modified sequence opt4 from neuraminidase__InfluenzaA__ADI75887

SEQ ID NO: 171453 - RNA, 1413 nt, Artificial Sequence; identical to SEQ ID NO: 169981
  derived and/or modified sequence opt4 from neuraminidase__InfluenzaA__ADI75909

SEQ ID NO: 171454 - RNA, 1410 nt, Artificial Sequence; identical to SEQ ID NO: 171004
  derived and/or modified sequence opt4 from neuraminidase__InfluenzaA__ADI75920

SEQ ID NO: 171455 - RNA, 1413 nt, Artificial Sequence; identical to SEQ ID NO: 169981
  derived and/or modified sequence opt4 from neuraminidase__InfluenzaA__ADI77352

SEQ ID NO: 171456 - RNA, 1410 nt, Artificial Sequence; identical to SEQ ID NO: 169258
  derived and/or modified sequence opt4 from neuraminidase__InfluenzaA__ADI77363

SEQ ID NO: 171457 - RNA, 1410 nt, Artificial Sequence; identical to SEQ ID NO: 170435
  derived and/or modified sequence opt4 from neuraminidase__InfluenzaA__ADI99500

SEQ ID NO: 171458 - RNA, 1410 nt, Artificial Sequence
  derived and/or modified sequence opt4 from neuraminidase__InfluenzaA__ADI99553
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggacagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171459 - RNA, 1410 nt, Artificial Sequence
  derived and/or modified sequence opt4 from neuraminidase__InfluenzaA__ADI99563
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggaggugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171460 - RNA, 1410 nt, Artificial Sequence; identical to SEQ ID NO: 171459
  derived and/or modified sequence opt4 from neuraminidase__InfluenzaA__ADI99573

SEQ ID NO: 171461 - RNA, 1410 nt, Artificial Sequence; identical to SEQ ID NO: 171459
  derived and/or modified sequence opt4 from neuraminidase__InfluenzaA__ADI99583

SEQ ID NO: 171462 - RNA, 1410 nt, Artificial Sequence; identical to SEQ ID NO: 170609
  derived and/or modified sequence opt4 from neuraminidase__InfluenzaA__ADI99593

SEQ ID NO: 171463 - RNA, 1410 nt, Artificial Sequence
  derived and/or modified sequence opt4 from neuraminidase__InfluenzaA__ADI99613
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 171464 - RNA, 1410 nt, Artificial Sequence
  derived and/or modified sequence opt4 from neuraminidase__InfluenzaA__ADI99623
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcaugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcaacgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171465 - RNA, 1410 nt, Artificial Sequence; identical to SEQ ID NO: 170546
  derived and/or modified sequence opt4 from neuraminidase__InfluenzaA__ADI99633

SEQ ID NO: 171466 - RNA, 1410 nt, Artificial Sequence; identical to SEQ ID NO: 170609
  derived and/or modified sequence opt4 from neuraminidase__InfluenzaA__ADI99643

SEQ ID NO: 171467 - RNA, 1410 nt, Artificial Sequence; identical to SEQ ID NO: 169258
  derived and/or modified sequence opt4 from neuraminidase__InfluenzaA__ADI99653

SEQ ID NO: 171468 - RNA, 1410 nt, Artificial Sequence; identical to SEQ ID NO: 169258
  derived and/or modified sequence opt4 from neuraminidase__InfluenzaA__ADI99663

SEQ ID NO: 171469 - RNA, 1410 nt, Artificial Sequence; identical to SEQ ID NO: 169258
  derived and/or modified sequence opt4 from neuraminidase__InfluenzaA__ADI99673

SEQ ID NO: 171470 - RNA, 1410 nt, Artificial Sequence; identical to SEQ ID NO: 169258
  derived and/or modified sequence opt4 from neuraminidase__InfluenzaA__ADI99683

SEQ ID NO: 171471 - RNA, 1410 nt, Artificial Sequence; identical to SEQ ID NO: 170720
  derived and/or modified sequence opt4 from neuraminidase__InfluenzaA__ADI99703

SEQ ID NO: 171472 - RNA, 1410 nt, Artificial Sequence; identical to SEQ ID NO: 169258
  derived and/or modified sequence opt4 from neuraminidase__InfluenzaA__ADI99713

SEQ ID NO: 171473 - RNA, 1410 nt, Artificial Sequence; identical to SEQ ID NO: 169258
  derived and/or modified sequence opt4 from neuraminidase__InfluenzaA__ADI99723

SEQ ID NO: 171474 - RNA, 1410 nt, Artificial Sequence; identical to SEQ ID NO: 169258
  derived and/or modified sequence opt4 from neuraminidase__InfluenzaA__ADI99733

SEQ ID NO: 171475 - RNA, 1410 nt, Artificial Sequence; identical to SEQ ID NO: 169413
  derived and/or modified sequence opt4 from neuraminidase__InfluenzaA__ADJ00487

SEQ ID NO: 171476 - RNA, 1410 nt, Artificial Sequence; identical to SEQ ID NO: 169413
  derived and/or modified sequence opt4 from neuraminidase__InfluenzaA__ADJ00488

SEQ ID NO: 171477 - RNA, 1410 nt, Artificial Sequence; identical to SEQ ID NO: 169413
  derived and/or modified sequence opt4 from neuraminidase__InfluenzaA__ADJ00489

SEQ ID NO: 171478 - RNA, 1410 nt, Artificial Sequence; identical to SEQ ID NO: 169413
  derived and/or modified sequence opt4 from neuraminidase__InfluenzaA__ADJ00490

SEQ ID NO: 171479 - RNA, 1410 nt, Artificial Sequence; identical to SEQ ID NO: 169413
  derived and/or modified sequence opt4 from neuraminidase__InfluenzaA__ADJ00491

SEQ ID NO: 171480 - RNA, 1410 nt, Artificial Sequence; identical to SEQ ID NO: 169258
  derived and/or modified sequence opt4 from neuraminidase__InfluenzaA__ADJ18160

SEQ ID NO: 171481 - RNA, 1410 nt, Artificial Sequence; identical to SEQ ID NO: 169258
  derived and/or modified sequence opt4 from neuraminidase__InfluenzaA__ADJ18161

SEQ ID NO: 171482 - RNA, 1410 nt, Artificial Sequence
  derived and/or modified sequence opt4 from neuraminidase__InfluenzaA__ADJ18162
augauccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagaaagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171483 - RNA, 1410 nt, Artificial Sequence
  derived and/or modified sequence opt4 from neuraminidase__InfluenzaA__ADJ18164
augaaccccaagcagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugcagcgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171484 - RNA, 1410 nt, Artificial Sequence; identical to SEQ ID NO: 169258
  derived and/or modified sequence opt4 from neuraminidase__InfluenzaA__ADJ18166

SEQ ID NO: 171485 - RNA, 1410 nt, Artificial Sequence; identical to SEQ ID NO: 169258
  derived and/or modified sequence opt4 from neuraminidase__InfluenzaA__ADJ18168

SEQ ID NO: 171486 - RNA, 1410 nt, Artificial Sequence; identical to SEQ ID NO: 169258
  derived and/or modified sequence opt4 from neuraminidase__InfluenzaA__ADJ18170

SEQ ID NO: 171487 - RNA, 1410 nt, Artificial Sequence
  derived and/or modified sequence opt4 from neuraminidase__InfluenzaA__ADJ18172
augaaccccaaccagaagaucaucaccaucggcagcgugugcaugaccaucggcauggccaaccugauccugagaaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagaaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171488 - RNA, 1410 nt, Artificial Sequence; identical to SEQ ID NO: 169258
  derived and/or modified sequence opt4 from neuraminidase__InfluenzaA__ADJ18174

SEQ ID NO: 171489 - RNA, 1410 nt, Artificial Sequence
  derived and/or modified sequence opt4 from neuraminidase__InfluenzaA__ADJ18176
augaaccccaaccagaagaucaucaccaucggcagcgugugcaugaccaucggcauggccaaccugauccugcagaucggcaacaucaucagcaucuggaucagccugagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171490 - RNA, 1410 nt, Artificial Sequence; identical to SEQ ID NO: 169031
  derived and/or modified sequence opt4 from neuraminidase__InfluenzaA__ADJ37250

SEQ ID NO: 171491 - RNA, 1410 nt, Artificial Sequence
  derived and/or modified sequence opt4 from neuraminidase__InfluenzaA__ADJ37252
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaucgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171492 - RNA, 1410 nt, Artificial Sequence; identical to SEQ ID NO: 169258
  derived and/or modified sequence opt4 from neuraminidase__InfluenzaA__ADJ37263

SEQ ID NO: 171493 - RNA, 1410 nt, Artificial Sequence; identical to SEQ ID NO: 169248
  derived and/or modified sequence opt4 from neuraminidase__InfluenzaA__ADJ37273

SEQ ID NO: 171494 - RNA, 1410 nt, Artificial Sequence; identical to SEQ ID NO: 169258
  derived and/or modified sequence opt4 from neuraminidase__InfluenzaA__ADJ40447

SEQ ID NO: 171495 - RNA, 1410 nt, Artificial Sequence; identical to SEQ ID NO: 169258
  derived and/or modified sequence opt4 from neuraminidase__InfluenzaA__ADJ40457

SEQ ID NO: 171496 - RNA, 1410 nt, Artificial Sequence; identical to SEQ ID NO: 170609
  derived and/or modified sequence opt4 from neuraminidase__InfluenzaA__ADJ40467

SEQ ID NO: 171497 - RNA, 1410 nt, Artificial Sequence
  derived and/or modified sequence opt4 from neuraminidase__InfluenzaA__ADJ40477
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccaugggcuggagcuggcccgacggcgccgagcugcccuucaccaucgacaaguga

SEQ ID NO: 171498 - RNA, 1410 nt, Artificial Sequence; identical to SEQ ID NO: 169258
  derived and/or modified sequence opt4 from neuraminidase__InfluenzaA__ADJ40487

SEQ ID NO: 171499 - RNA, 1410 nt, Artificial Sequence; identical to SEQ ID NO: 169258
  derived and/or modified sequence opt4 from neuraminidase__InfluenzaA__ADJ40507

SEQ ID NO: 171500 - RNA, 1410 nt, Artificial Sequence; identical to SEQ ID NO: 169258
  derived and/or modified sequence opt4 from neuraminidase__InfluenzaA__ADJ40517

SEQ ID NO: 171501 - RNA, 1410 nt, Artificial Sequence; identical to SEQ ID NO: 169258
  derived and/or modified sequence opt4 from neuraminidase__InfluenzaA__ADJ40527

SEQ ID NO: 171502 - RNA, 1410 nt, Artificial Sequence
  derived and/or modified sequence opt4 from neuraminidase__InfluenzaA__ADJ40537
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcggcgugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171503 - RNA, 1410 nt, Artificial Sequence
  derived and/or modified sequence opt4 from neuraminidase__InfluenzaA__ADJ40547
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171504 - RNA, 1410 nt, Artificial Sequence; identical to SEQ ID NO: 169258
  derived and/or modified sequence opt4 from neuraminidase__InfluenzaA__ADJ40557

SEQ ID NO: 171505 - RNA, 1410 nt, Artificial Sequence; identical to SEQ ID NO: 169258
  derived and/or modified sequence opt4 from neuraminidase__InfluenzaA__ADJ40577

SEQ ID NO: 171506 - RNA, 1410 nt, Artificial Sequence; identical to SEQ ID NO: 169258
  derived and/or modified sequence opt4 from neuraminidase__InfluenzaA__ADJ40587

SEQ ID NO: 171507 - RNA, 1410 nt, Artificial Sequence
  derived and/or modified sequence opt4 from neuraminidase__InfluenzaA__ADJ40597
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuuccugaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171508 - RNA, 1410 nt, Artificial Sequence; identical to SEQ ID NO: 169258
  derived and/or modified sequence opt4 from neuraminidase__InfluenzaA__ADJ40607

SEQ ID NO: 171509 - RNA, 1410 nt, Artificial Sequence; identical to SEQ ID NO: 169258
  derived and/or modified sequence opt4 from neuraminidase__InfluenzaA__ADJ40617

SEQ ID NO: 171510 - RNA, 1410 nt, Artificial Sequence; identical to SEQ ID NO: 169612
  derived and/or modified sequence opt4 from neuraminidase__InfluenzaA__ADJ40627

SEQ ID NO: 171511 - RNA, 1410 nt, Artificial Sequence; identical to SEQ ID NO: 169258
  derived and/or modified sequence opt4 from neuraminidase__InfluenzaA__ADJ40637

SEQ ID NO: 171512 - RNA, 1410 nt, Artificial Sequence; identical to SEQ ID NO: 169258
  derived and/or modified sequence opt4 from neuraminidase__InfluenzaA__ADJ40657

SEQ ID NO: 171513 - RNA, 1410 nt, Artificial Sequence; identical to SEQ ID NO: 169258
  derived and/or modified sequence opt4 from neuraminidase__InfluenzaA__ADJ40667

SEQ ID NO: 171514 - RNA, 1410 nt, Artificial Sequence; identical to SEQ ID NO: 169258
  derived and/or modified sequence opt4 from neuraminidase__InfluenzaA__ADJ40677

SEQ ID NO: 171515 - RNA, 1410 nt, Artificial Sequence
  derived and/or modified sequence opt4 from neuraminidase__InfluenzaA__ADJ41819
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccagguggugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcaucaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 171516 - RNA, 1410 nt, Artificial Sequence; identical to SEQ ID NO: 169258
  derived and/or modified sequence opt4 from neuraminidase__InfluenzaA__ADJ56642

SEQ ID NO: 171517 - RNA, 1410 nt, Artificial Sequence; identical to SEQ ID NO: 169258
  derived and/or modified sequence opt4 from neuraminidase__InfluenzaA__ADJ56652

SEQ ID NO: 171518 - RNA, 1410 nt, Artificial Sequence; identical to SEQ ID NO: 169258
  derived and/or modified sequence opt4 from neuraminidase__InfluenzaA__ADJ80637

SEQ ID NO: 171519 - RNA, 1410 nt, Artificial Sequence; identical to SEQ ID NO: 170276
  derived and/or modified sequence opt4 from neuraminidase__InfluenzaA__ADJ80647

SEQ ID NO: 171520 - RNA, 1410 nt, Artificial Sequence; identical to SEQ ID NO: 170276
  derived and/or modified sequence opt4 from neuraminidase__InfluenzaA__ADJ80657

SEQ ID NO: 171521 - RNA, 1410 nt, Artificial Sequence; identical to SEQ ID NO: 169258
  derived and/or modified sequence opt4 from neuraminidase__InfluenzaA__ADJ80667

SEQ ID NO: 171522 - RNA, 1410 nt, Artificial Sequence; identical to SEQ ID NO: 171171
  derived and/or modified sequence opt4 from neuraminidase__InfluenzaA__ADJ80677

SEQ ID NO: 171523 - RNA, 1410 nt, Artificial Sequence; identical to SEQ ID NO: 170546
  derived and/or modified sequence opt4 from neuraminidase__InfluenzaA__ADJ80687

SEQ ID NO: 171524 - RNA, 1410 nt, Artificial Sequence
  derived and/or modified sequence opt4 from neuraminidase__InfluenzaA__ADJ80697
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcgugaucagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171525 - RNA, 1410 nt, Artificial Sequence
  derived and/or modified sequence opt4 from neuraminidase__InfluenzaA__ADJ80717
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccguguacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171526 - RNA, 1410 nt, Artificial Sequence
  derived and/or modified sequence opt4 from neuraminidase__InfluenzaA__ADJ80727
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggugaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171527 - RNA, 1410 nt, Artificial Sequence; identical to SEQ ID NO: 170025
  derived and/or modified sequence opt4 from neuraminidase__InfluenzaA__ADJ80737

SEQ ID NO: 171528 - RNA, 1410 nt, Artificial Sequence
  derived and/or modified sequence opt4 from neuraminidase__InfluenzaA__ADJ80747
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcagcagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagagaggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucguggagaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171529 - RNA, 1410 nt, Artificial Sequence; identical to SEQ ID NO: 169258
  derived and/or modified sequence opt4 from neuraminidase__InfluenzaA__ADJ80757

SEQ ID NO: 171530 - RNA, 1410 nt, Artificial Sequence; identical to SEQ ID NO: 169258
  derived and/or modified sequence opt4 from neuraminidase__InfluenzaA__ADJ80767

SEQ ID NO: 171531 - RNA, 1410 nt, Artificial Sequence; identical to SEQ ID NO: 169841
  derived and/or modified sequence opt4 from neuraminidase__InfluenzaA__ADJ80777

SEQ ID NO: 171532 - RNA, 1410 nt, Artificial Sequence; identical to SEQ ID NO: 169258
  derived and/or modified sequence opt4 from neuraminidase__InfluenzaA__ADJ80787

SEQ ID NO: 171533 - RNA, 1410 nt, Artificial Sequence
  derived and/or modified sequence opt4 from neuraminidase__InfluenzaA__ADJ80797
augaaccccaaccagaagaucaucaccaucggcagcgugugcaugaccaucggcauggccaaccugauccugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171534 - RNA, 1410 nt, Artificial Sequence; identical to SEQ ID NO: 170276
  derived and/or modified sequence opt4 from neuraminidase__InfluenzaA__ADJ80807

SEQ ID NO: 171535 - RNA, 1410 nt, Artificial Sequence; identical to SEQ ID NO: 169258
  derived and/or modified sequence opt4 from neuraminidase__InfluenzaA__ADJ80817

SEQ ID NO: 171536 - RNA, 1410 nt, Artificial Sequence; identical to SEQ ID NO: 169258
  derived and/or modified sequence opt4 from neuraminidase__InfluenzaA__ADJ80827

SEQ ID NO: 171537 - RNA, 1410 nt, Artificial Sequence; identical to SEQ ID NO: 170771
  derived and/or modified sequence opt4 from neuraminidase__InfluenzaA__ADJ80837

SEQ ID NO: 171538 - RNA, 1410 nt, Artificial Sequence; identical to SEQ ID NO: 171269
  derived and/or modified sequence opt4 from neuraminidase__InfluenzaA__ADJ80851

SEQ ID NO: 171539 - RNA, 1410 nt, Artificial Sequence
  derived and/or modified sequence opt4 from neuraminidase__InfluenzaA__ADJ80861
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagccccaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171540 - RNA, 1410 nt, Artificial Sequence; identical to SEQ ID NO: 171533
  derived and/or modified sequence opt4 from neuraminidase__InfluenzaA__ADJ80871

SEQ ID NO: 171541 - RNA, 1410 nt, Artificial Sequence; identical to SEQ ID NO: 169258
  derived and/or modified sequence opt4 from neuraminidase__InfluenzaA__ADJ80886

SEQ ID NO: 171542 - RNA, 1410 nt, Artificial Sequence
  derived and/or modified sequence opt4 from neuraminidase__InfluenzaA__ADJ80896
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcugaccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171543 - RNA, 1410 nt, Artificial Sequence
  derived and/or modified sequence opt4 from neuraminidase__InfluenzaA__ADJ80913
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcagcagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaagcggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171544 - RNA, 1410 nt, Artificial Sequence; identical to SEQ ID NO: 169258
  derived and/or modified sequence opt4 from neuraminidase__InfluenzaA__ADJ80930

SEQ ID NO: 171545 - RNA, 1410 nt, Artificial Sequence; identical to SEQ ID NO: 169258
  derived and/or modified sequence opt4 from neuraminidase__InfluenzaA__ADJ80950

SEQ ID NO: 171546 - RNA, 1410 nt, Artificial Sequence; identical to SEQ ID NO: 170546
  derived and/or modified sequence opt4 from neuraminidase__InfluenzaA__ADJ80960

SEQ ID NO: 171547 - RNA, 1410 nt, Artificial Sequence; identical to SEQ ID NO: 171533
  derived and/or modified sequence opt4 from neuraminidase__InfluenzaA__ADJ80970

SEQ ID NO: 171548 - RNA, 1410 nt, Artificial Sequence; identical to SEQ ID NO: 169258
  derived and/or modified sequence opt4 from neuraminidase__InfluenzaA__ADJ80980

SEQ ID NO: 171549 - RNA, 1410 nt, Artificial Sequence; identical to SEQ ID NO: 171533
  derived and/or modified sequence opt4 from neuraminidase__InfluenzaA__ADJ80996

SEQ ID NO: 171550 - RNA, 1410 nt, Artificial Sequence
  derived and/or modified sequence opt4 from neuraminidase__InfluenzaA__ADJ81006
augaaccccaaccagaagaucaucaccaucggcagcgugugcaugaccaucggcauggccaaccugauccugcaggugggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaccagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171551 - RNA, 1410 nt, Artificial Sequence; identical to SEQ ID NO: 171269
  derived and/or modified sequence opt4 from neuraminidase__InfluenzaA__ADJ81016

SEQ ID NO: 171552 - RNA, 1410 nt, Artificial Sequence; identical to SEQ ID NO: 171458
  derived and/or modified sequence opt4 from neuraminidase__InfluenzaA__ADJ81026

SEQ ID NO: 171553 - RNA, 1410 nt, Artificial Sequence; identical to SEQ ID NO: 169258
  derived and/or modified sequence opt4 from neuraminidase__InfluenzaA__ADJ81036

SEQ ID NO: 171554 - RNA, 1410 nt, Artificial Sequence
  derived and/or modified sequence opt4 from neuraminidase__InfluenzaA__ADJ81046
augaaccccaaccagaagaucaucaccaucggcagcgugugcaugaccgugggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaacagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171555 - RNA, 1410 nt, Artificial Sequence
  derived and/or modified sequence opt4 from neuraminidase__InfluenzaA__ADJ81056
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugcccgugaagcuggccggcagcagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucaacagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171556 - RNA, 1410 nt, Artificial Sequence; identical to SEQ ID NO: 170546
  derived and/or modified sequence opt4 from neuraminidase__InfluenzaA__ADJ81066

SEQ ID NO: 171557 - RNA, 1410 nt, Artificial Sequence; identical to SEQ ID NO: 169119
  derived and/or modified sequence opt4 from neuraminidase__InfluenzaA__ADJ84775

SEQ ID NO: 171558 - RNA, 1410 nt, Artificial Sequence
  derived and/or modified sequence opt4 from neuraminidase__InfluenzaA__ADJ88785
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcguggugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 171559 - RNA, 1410 nt, Artificial Sequence; identical to SEQ ID NO: 169258
  derived and/or modified sequence opt4 from neuraminidase__InfluenzaA__ADK21716

SEQ ID NO: 171560 - RNA, 1410 nt, Artificial Sequence; identical to SEQ ID NO: 169258
  derived and/or modified sequence opt4 from neuraminidase__InfluenzaA__ADK21726

SEQ ID NO: 171561 - RNA, 1410 nt, Artificial Sequence; identical to SEQ ID NO: 169258
  derived and/or modified sequence opt4 from neuraminidase__InfluenzaA__ADK21736

SEQ ID NO: 171562 - RNA, 1410 nt, Artificial Sequence
  derived and/or modified sequence opt4 from neuraminidase__InfluenzaA__ADK21746
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagcacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaagcggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 171563 - RNA, 1410 nt, Artificial Sequence; identical to SEQ ID NO: 169258
  derived and/or modified sequence opt4 from neuraminidase__InfluenzaA__ADK21756

SEQ ID NO: 171564 - RNA, 1410 nt, Artificial Sequence; identical to SEQ ID NO: 169258
  derived and/or modified sequence opt4 from neuraminidase__InfluenzaA__ADK21766

SEQ ID NO: 171565 - RNA, 1410 nt, Artificial Sequence; identical to SEQ ID NO: 170689
  derived and/or modified sequence opt4 from neuraminidase__InfluenzaA__ADK21776

SEQ ID NO: 171566 - RNA, 1410 nt, Artificial Sequence; identical to SEQ ID NO: 169258
  derived and/or modified sequence opt4 from neuraminidase__InfluenzaA__ADK21786

SEQ ID NO: 171567 - RNA, 1410 nt, Artificial Sequence; identical to SEQ ID NO: 169258
  derived and/or modified sequence opt4 from neuraminidase__InfluenzaA__ADK21796

SEQ ID NO: 171568 - RNA, 1410 nt, Artificial Sequence; identical to SEQ ID NO: 169258
  derived and/or modified sequence opt4 from neuraminidase__InfluenzaA__ADK21806

SEQ ID NO: 171569 - RNA, 1410 nt, Artificial Sequence; identical to SEQ ID NO: 169258
  derived and/or modified sequence opt4 from neuraminidase__InfluenzaA__ADK21816

SEQ ID NO: 171570 - RNA, 1410 nt, Artificial Sequence; identical to SEQ ID NO: 171236
  derived and/or modified sequence opt4 from neuraminidase__InfluenzaA__ADK21826

SEQ ID NO: 171571 - RNA, 1410 nt, Artificial Sequence; identical to SEQ ID NO: 171149
  derived and/or modified sequence opt4 from neuraminidase__InfluenzaA__ADK21836

SEQ ID NO: 171572 - RNA, 1410 nt, Artificial Sequence
  derived and/or modified sequence opt4 from neuraminidase__InfluenzaA__ADK21846
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaugaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucugggccagcggcagcagcaucagcuucugcggcgugaacagcgacaccgugggcuggagcuggcccgacggcgccgagcugcccuucaccaucgacaaguga

SEQ ID NO: 171573 - RNA, 1410 nt, Artificial Sequence; identical to SEQ ID NO: 169258
  derived and/or modified sequence opt4 from neuraminidase__InfluenzaA__ADK21856

SEQ ID NO: 171574 - RNA, 1410 nt, Artificial Sequence; identical to SEQ ID NO: 169258
  derived and/or modified sequence opt4 from neuraminidase__InfluenzaA__ADK21866

SEQ ID NO: 171575 - RNA, 1410 nt, Artificial Sequence; identical to SEQ ID NO: 169258
  derived and/or modified sequence opt4 from neuraminidase__InfluenzaA__ADK21876

SEQ ID NO: 171576 - RNA, 1410 nt, Artificial Sequence; identical to SEQ ID NO: 169258
  derived and/or modified sequence opt4 from neuraminidase__InfluenzaA__ADK21886

SEQ ID NO: 171577 - RNA, 1410 nt, Artificial Sequence
  derived and/or modified sequence opt4 from neuraminidase__InfluenzaA__ADK21896
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugagcagcgacaccgugggcuggagcuggcccgacggcgccgagcugcccuucaccaucgacaaguga

SEQ ID NO: 171578 - RNA, 1410 nt, Artificial Sequence
  derived and/or modified sequence opt4 from neuraminidase__InfluenzaA__ADK21906
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccuggaucagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucggcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171579 - RNA, 1410 nt, Artificial Sequence; identical to SEQ ID NO: 169258
  derived and/or modified sequence opt4 from neuraminidase__InfluenzaA__ADK21916

SEQ ID NO: 171580 - RNA, 1410 nt, Artificial Sequence; identical to SEQ ID NO: 169258
  derived and/or modified sequence opt4 from neuraminidase__InfluenzaA__ADK21926

SEQ ID NO: 171581 - RNA, 1410 nt, Artificial Sequence; identical to SEQ ID NO: 169258
  derived and/or modified sequence opt4 from neuraminidase__InfluenzaA__ADK21936

SEQ ID NO: 171582 - RNA, 1410 nt, Artificial Sequence
  derived and/or modified sequence opt4 from neuraminidase__InfluenzaA__ADK21946
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171583 - RNA, 1410 nt, Artificial Sequence
  derived and/or modified sequence opt4 from neuraminidase__InfluenzaA__ADK21956
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcaacaccgugggcuggagcuggcccgacggcgccgagcugcccuucaccaucgacaaguga

SEQ ID NO: 171584 - RNA, 1410 nt, Artificial Sequence; identical to SEQ ID NO: 169258
  derived and/or modified sequence opt4 from neuraminidase__InfluenzaA__ADK32393

SEQ ID NO: 171585 - RNA, 1410 nt, Artificial Sequence; identical to SEQ ID NO: 169258
  derived and/or modified sequence opt4 from neuraminidase__InfluenzaA__ADK32403

SEQ ID NO: 171586 - RNA, 1410 nt, Artificial Sequence; identical to SEQ ID NO: 169258
  derived and/or modified sequence opt4 from neuraminidase__InfluenzaA__ADK32413

SEQ ID NO: 171587 - RNA, 1410 nt, Artificial Sequence
  derived and/or modified sequence opt4 from neuraminidase__InfluenzaA__ADK32423
augaaccccaaccagaagaucaucaccaucggcagcgugugcaugaccaucggcaugaccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171588 - RNA, 1410 nt, Artificial Sequence; identical to SEQ ID NO: 169258
  derived and/or modified sequence opt4 from neuraminidase__InfluenzaA__ADK32433

SEQ ID NO: 171589 - RNA, 1410 nt, Artificial Sequence; identical to SEQ ID NO: 169258
  derived and/or modified sequence opt4 from neuraminidase__InfluenzaA__ADK32443

SEQ ID NO: 171590 - RNA, 1410 nt, Artificial Sequence
  derived and/or modified sequence opt4 from neuraminidase__InfluenzaA__ADK32453
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcugagcggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171591 - RNA, 1410 nt, Artificial Sequence
  derived and/or modified sequence opt4 from neuraminidase__InfluenzaA__ADK32463
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugaucaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171592 - RNA, 1410 nt, Artificial Sequence; identical to SEQ ID NO: 169258
  derived and/or modified sequence opt4 from neuraminidase__InfluenzaA__ADK32473

SEQ ID NO: 171593 - RNA, 1410 nt, Artificial Sequence; identical to SEQ ID NO: 169258
  derived and/or modified sequence opt4 from neuraminidase__InfluenzaA__ADK32483

SEQ ID NO: 171594 - RNA, 1410 nt, Artificial Sequence; identical to SEQ ID NO: 169258
  derived and/or modified sequence opt4 from neuraminidase__InfluenzaA__ADK32493

SEQ ID NO: 171595 - RNA, 1410 nt, Artificial Sequence; identical to SEQ ID NO: 171171
  derived and/or modified sequence opt4 from neuraminidase__InfluenzaA__ADK32505

SEQ ID NO: 171596 - RNA, 1410 nt, Artificial Sequence
  derived and/or modified sequence opt4 from neuraminidase__InfluenzaA__ADK32640
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggccagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171597 - RNA, 1410 nt, Artificial Sequence; identical to SEQ ID NO: 169258
  derived and/or modified sequence opt4 from neuraminidase__InfluenzaA__ADK32650

SEQ ID NO: 171598 - RNA, 1410 nt, Artificial Sequence; identical to SEQ ID NO: 169258
  derived and/or modified sequence opt4 from neuraminidase__InfluenzaA__ADK32660

SEQ ID NO: 171599 - RNA, 1410 nt, Artificial Sequence; identical to SEQ ID NO: 169258
  derived and/or modified sequence opt4 from neuraminidase__InfluenzaA__ADK32670

SEQ ID NO: 171600 - RNA, 1410 nt, Artificial Sequence
  derived and/or modified sequence opt4 from neuraminidase__InfluenzaA__ADK32680
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacaagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171601 - RNA, 1410 nt, Artificial Sequence; identical to SEQ ID NO: 169258
  derived and/or modified sequence opt4 from neuraminidase__InfluenzaA__ADK32690

SEQ ID NO: 171602 - RNA, 1410 nt, Artificial Sequence; identical to SEQ ID NO: 169258
  derived and/or modified sequence opt4 from neuraminidase__InfluenzaA__ADK32700

SEQ ID NO: 171603 - RNA, 1410 nt, Artificial Sequence; identical to SEQ ID NO: 169258
  derived and/or modified sequence opt4 from neuraminidase__InfluenzaA__ADK32779

SEQ ID NO: 171604 - RNA, 1410 nt, Artificial Sequence; identical to SEQ ID NO: 169258
  derived and/or modified sequence opt4 from neuraminidase__InfluenzaA__ADK33614

SEQ ID NO: 171605 - RNA, 1410 nt, Artificial Sequence; identical to SEQ ID NO: 169258
  derived and/or modified sequence opt4 from neuraminidase__InfluenzaA__ADK33624

SEQ ID NO: 171606 - RNA, 1410 nt, Artificial Sequence; identical to SEQ ID NO: 169258
  derived and/or modified sequence opt4 from neuraminidase__InfluenzaA__ADK33634

SEQ ID NO: 171607 - RNA, 1410 nt, Artificial Sequence
  derived and/or modified sequence opt4 from neuraminidase__InfluenzaA__ADK33644
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggcagcgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171608 - RNA, 1410 nt, Artificial Sequence; identical to SEQ ID NO: 170989
  derived and/or modified sequence opt4 from neuraminidase__InfluenzaA__ADK33654

SEQ ID NO: 171609 - RNA, 1410 nt, Artificial Sequence; identical to SEQ ID NO: 170989
  derived and/or modified sequence opt4 from neuraminidase__InfluenzaA__ADK33664

SEQ ID NO: 171610 - RNA, 1410 nt, Artificial Sequence; identical to SEQ ID NO: 169258
  derived and/or modified sequence opt4 from neuraminidase__InfluenzaA__ADK33674

SEQ ID NO: 171611 - RNA, 1410 nt, Artificial Sequence; identical to SEQ ID NO: 169258
  derived and/or modified sequence opt4 from neuraminidase__InfluenzaA__ADK33684

SEQ ID NO: 171612 - RNA, 1410 nt, Artificial Sequence; identical to SEQ ID NO: 170609
  derived and/or modified sequence opt4 from neuraminidase__InfluenzaA__ADK33694

SEQ ID NO: 171613 - RNA, 1410 nt, Artificial Sequence; identical to SEQ ID NO: 169258
  derived and/or modified sequence opt4 from neuraminidase__InfluenzaA__ADK33704

SEQ ID NO: 171614 - RNA, 1410 nt, Artificial Sequence; identical to SEQ ID NO: 169258
  derived and/or modified sequence opt4 from neuraminidase__InfluenzaA__ADK33714

SEQ ID NO: 171615 - RNA, 1410 nt, Artificial Sequence; identical to SEQ ID NO: 169258
  derived and/or modified sequence opt4 from neuraminidase__InfluenzaA__ADK33744

SEQ ID NO: 171616 - RNA, 1410 nt, Artificial Sequence
  derived and/or modified sequence opt4 from neuraminidase__InfluenzaA__ADK33754
augaaccccaaccagaagaucaucaccaucggcagcgugugcaugaccaucggcauggccaacuucauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171617 - RNA, 1410 nt, Artificial Sequence
  derived and/or modified sequence opt4 from neuraminidase__InfluenzaA__ADK33764
augaaccccaaccagaagaucaucaccaucggcagcgugugcaugaccaucggcauggccaacuucauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171618 - RNA, 1410 nt, Artificial Sequence
  derived and/or modified sequence opt4 from neuraminidase__InfluenzaA__ADK33774
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggugggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171619 - RNA, 1410 nt, Artificial Sequence; identical to SEQ ID NO: 170232
  derived and/or modified sequence opt4 from neuraminidase__InfluenzaA__ADK33784

SEQ ID NO: 171620 - RNA, 1410 nt, Artificial Sequence; identical to SEQ ID NO: 169258
  derived and/or modified sequence opt4 from neuraminidase__InfluenzaA__ADK33794

SEQ ID NO: 171621 - RNA, 1410 nt, Artificial Sequence; identical to SEQ ID NO: 169258
  derived and/or modified sequence opt4 from neuraminidase__InfluenzaA__ADK33804

SEQ ID NO: 171622 - RNA, 1410 nt, Artificial Sequence
  derived and/or modified sequence opt4 from neuraminidase__InfluenzaA__ADK33814
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaacaagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171623 - RNA, 1410 nt, Artificial Sequence
  derived and/or modified sequence opt4 from neuraminidase__InfluenzaA__ADK33824
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacaucaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171624 - RNA, 1410 nt, Artificial Sequence; identical to SEQ ID NO: 170435
  derived and/or modified sequence opt4 from neuraminidase__InfluenzaA__ADK33834

SEQ ID NO: 171625 - RNA, 1410 nt, Artificial Sequence
  derived and/or modified sequence opt4 from neuraminidase__InfluenzaA__ADK33844
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgccaagcuggccggcaacagcccccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171626 - RNA, 1410 nt, Artificial Sequence; identical to SEQ ID NO: 170435
  derived and/or modified sequence opt4 from neuraminidase__InfluenzaA__ADK33854

SEQ ID NO: 171627 - RNA, 1410 nt, Artificial Sequence; identical to SEQ ID NO: 171149
  derived and/or modified sequence opt4 from neuraminidase__InfluenzaA__ADK33864

SEQ ID NO: 171628 - RNA, 1410 nt, Artificial Sequence
  derived and/or modified sequence opt4 from neuraminidase__InfluenzaA__ADK33874
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuaccugugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171629 - RNA, 1410 nt, Artificial Sequence; identical to SEQ ID NO: 169258
  derived and/or modified sequence opt4 from neuraminidase__InfluenzaA__ADK33884

SEQ ID NO: 171630 - RNA, 1410 nt, Artificial Sequence; identical to SEQ ID NO: 170435
  derived and/or modified sequence opt4 from neuraminidase__InfluenzaA__ADK33894

SEQ ID NO: 171631 - RNA, 1410 nt, Artificial Sequence; identical to SEQ ID NO: 170435
  derived and/or modified sequence opt4 from neuraminidase__InfluenzaA__ADK33904

SEQ ID NO: 171632 - RNA, 1410 nt, Artificial Sequence; identical to SEQ ID NO: 171215
  derived and/or modified sequence opt4 from neuraminidase__InfluenzaA__ADK33914

SEQ ID NO: 171633 - RNA, 1410 nt, Artificial Sequence
  derived and/or modified sequence opt4 from neuraminidase__InfluenzaA__ADK33924
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcaacaccgugggcuggagcuggcccgacggcgccgagcugcccuucaccaucgacaaguga

SEQ ID NO: 171634 - RNA, 1410 nt, Artificial Sequence; identical to SEQ ID NO: 169258
  derived and/or modified sequence opt4 from neuraminidase__InfluenzaA__ADK33934

SEQ ID NO: 171635 - RNA, 1410 nt, Artificial Sequence; identical to SEQ ID NO: 169258
  derived and/or modified sequence opt4 from neuraminidase__InfluenzaA__ADK33944

SEQ ID NO: 171636 - RNA, 1410 nt, Artificial Sequence; identical to SEQ ID NO: 171215
  derived and/or modified sequence opt4 from neuraminidase__InfluenzaA__ADK33954

SEQ ID NO: 171637 - RNA, 1410 nt, Artificial Sequence; identical to SEQ ID NO: 169258
  derived and/or modified sequence opt4 from neuraminidase__InfluenzaA__ADK33964

SEQ ID NO: 171638 - RNA, 1410 nt, Artificial Sequence; identical to SEQ ID NO: 170365
  derived and/or modified sequence opt4 from neuraminidase__InfluenzaA__ADK33974

SEQ ID NO: 171639 - RNA, 1410 nt, Artificial Sequence; identical to SEQ ID NO: 169258
  derived and/or modified sequence opt4 from neuraminidase__InfluenzaA__ADK33984

SEQ ID NO: 171640 - RNA, 1410 nt, Artificial Sequence
  derived and/or modified sequence opt4 from neuraminidase__InfluenzaA__ADK39016
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccgacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171641 - RNA, 1410 nt, Artificial Sequence; identical to SEQ ID NO: 169119
  derived and/or modified sequence opt4 from neuraminidase__InfluenzaA__ADK45315

SEQ ID NO: 171642 - RNA, 1410 nt, Artificial Sequence
  derived and/or modified sequence opt4 from neuraminidase__InfluenzaA__ADK45413
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcuguacgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgccagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171643 - RNA, 1410 nt, Artificial Sequence
  derived and/or modified sequence opt4 from neuraminidase__InfluenzaA__ADK45424
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuaccugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171644 - RNA, 1410 nt, Artificial Sequence; identical to SEQ ID NO: 170425
  derived and/or modified sequence opt4 from neuraminidase__InfluenzaA__ADK45446

SEQ ID NO: 171645 - RNA, 1410 nt, Artificial Sequence
  derived and/or modified sequence opt4 from neuraminidase__InfluenzaA__ADK45457
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcggcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171646 - RNA, 1410 nt, Artificial Sequence
  derived and/or modified sequence opt4 from neuraminidase__InfluenzaA__ADK45479
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagguggugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggaggccgaggugcuguggaccagcaacagcaucgugguguucugcggcaccagcggcaccuacggcaccggcagcuggcccgacggcgccgaccugaaccugaugcccaucuga

SEQ ID NO: 171647 - RNA, 1410 nt, Artificial Sequence; identical to SEQ ID NO: 169258
  derived and/or modified sequence opt4 from neuraminidase__InfluenzaA__ADK48799

SEQ ID NO: 171648 - RNA, 1410 nt, Artificial Sequence; identical to SEQ ID NO: 171171
  derived and/or modified sequence opt4 from neuraminidase__InfluenzaA__ADK62686

SEQ ID NO: 171649 - RNA, 1410 nt, Artificial Sequence; identical to SEQ ID NO: 170609
  derived and/or modified sequence opt4 from neuraminidase__InfluenzaA__ADK62696

SEQ ID NO: 171650 - RNA, 1410 nt, Artificial Sequence; identical to SEQ ID NO: 169841
  derived and/or modified sequence opt4 from neuraminidase__InfluenzaA__ADK64994

SEQ ID NO: 171651 - RNA, 1410 nt, Artificial Sequence
  derived and/or modified sequence opt4 from neuraminidase__InfluenzaA__ADK65002
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaccggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccggccugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171652 - RNA, 1410 nt, Artificial Sequence; identical to SEQ ID NO: 169258
  derived and/or modified sequence opt4 from neuraminidase__InfluenzaA__ADK65010

SEQ ID NO: 171653 - RNA, 1410 nt, Artificial Sequence
  derived and/or modified sequence opt4 from neuraminidase__InfluenzaA__ADK65018
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggcccgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcaucgagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171654 - RNA, 1410 nt, Artificial Sequence
  derived and/or modified sequence opt4 from neuraminidase__InfluenzaA__ADK87290
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccuacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 171655 - RNA, 1410 nt, Artificial Sequence
  derived and/or modified sequence opt4 from neuraminidase__InfluenzaA__ADK87292
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgccugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 171656 - RNA, 1410 nt, Artificial Sequence
  derived and/or modified sequence opt4 from neuraminidase__InfluenzaA__ADK87294
augaaccccaaccagaagaucaucgccaucggcagcgugagccugaccaucagcaccaucugcuucuuccugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugcagagacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaccggcaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacaacaucgugguguucugcggcaccagcggcaccuacggcaccggcagcuggcccgacggcgccgacaucaaccugaugcccguguga

SEQ ID NO: 171657 - RNA, 1410 nt, Artificial Sequence
  derived and/or modified sequence opt4 from neuraminidase__InfluenzaA__ADK87297
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaagaacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171658 - RNA, 1410 nt, Artificial Sequence
  derived and/or modified sequence opt4 from neuraminidase__InfluenzaA__ADK87299
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuucaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171659 - RNA, 1410 nt, Artificial Sequence
  derived and/or modified sequence opt4 from neuraminidase__InfluenzaA__ADK87301
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggccaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171660 - RNA, 1410 nt, Artificial Sequence; identical to SEQ ID NO: 169119
  derived and/or modified sequence opt4 from neuraminidase__InfluenzaA__ADK87303

SEQ ID NO: 171661 - RNA, 1410 nt, Artificial Sequence
  derived and/or modified sequence opt4 from neuraminidase__InfluenzaA__ADK87305
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucgugggcagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 171662 - RNA, 1410 nt, Artificial Sequence
  derived and/or modified sequence opt4 from neuraminidase__InfluenzaA__ADK87307
augaaccccaaccagaaggugaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucgugggcagaggcaacagaagcggcuacagcggcaucuucagcguggagggcaagagcugcaucaacagaugcuucuacguggagcugaucggcggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 171663 - RNA, 1410 nt, Artificial Sequence
  derived and/or modified sequence opt4 from neuraminidase__InfluenzaA__ADK87312
augaaccccaaccagaccaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcgugaucagcgugaagcuggccggcaacagcagccugugccccgugagcggcugggccaucuacagcaaggacaacaacaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171664 - RNA, 1410 nt, Artificial Sequence
  derived and/or modified sequence opt4 from neuraminidase__InfluenzaA__ADK87314
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagggcaacaucaccgagaucguguaccugaccaacaccaccaucgagaaggagaugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcaccagcagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 171665 - RNA, 1410 nt, Artificial Sequence
  derived and/or modified sequence opt4 from neuraminidase__InfluenzaA__ADK87316
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagaucaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171666 - RNA, 1410 nt, Artificial Sequence
  derived and/or modified sequence opt4 from neuraminidase__InfluenzaA__ADK87318
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcagcuggguggagcugaucagaggcagacccaaggagaacaccaucuggaccagcggcagcagcaccagcuucugcggcgugaacagcgacaccgugggcuggagcuggcccgacggcgccgagcugcccuucaccaucgacaaguga

SEQ ID NO: 171667 - RNA, 1410 nt, Artificial Sequence
  derived and/or modified sequence opt4 from neuraminidase__InfluenzaA__ADK87320
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugcaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccugaacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171668 - RNA, 1410 nt, Artificial Sequence
  derived and/or modified sequence opt4 from neuraminidase__InfluenzaA__ADK87324
augaaccccaaccagaagaucaucaccaucggcagcgugagccugaccaucagcaccaucugcuuccugaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacgagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 171669 - RNA, 1410 nt, Artificial Sequence
  derived and/or modified sequence opt4 from neuraminidase__InfluenzaA__ADK87327
augaaccccaaccagaagaucaugaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagagaagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 171670 - RNA, 1410 nt, Artificial Sequence; identical to SEQ ID NO: 169258
  derived and/or modified sequence opt4 from neuraminidase__InfluenzaA__ADK87329

SEQ ID NO: 171671 - RNA, 1410 nt, Artificial Sequence
  derived and/or modified sequence opt4 from neuraminidase__InfluenzaA__ADK87330
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucugggccagcggcagcagcaucagcuucugcggcgugaacagcgacaccgugggcuggagcuggcccgacggcgccgagcugcccuucaccaucgacaaguga

SEQ ID NO: 171672 - RNA, 1410 nt, Artificial Sequence; identical to SEQ ID NO: 169258
  derived and/or modified sequence opt4 from neuraminidase__InfluenzaA__ADK87331

SEQ ID NO: 171673 - RNA, 1410 nt, Artificial Sequence
  derived and/or modified sequence opt4 from neuraminidase__InfluenzaA__ADK87332
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaagcacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171674 - RNA, 1410 nt, Artificial Sequence
  derived and/or modified sequence opt4 from neuraminidase__InfluenzaA__ADK87333
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccuacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171675 - RNA, 1410 nt, Artificial Sequence
  derived and/or modified sequence opt4 from neuraminidase__InfluenzaA__ADK87335
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacagaagauaccaguucgcccugggccagggcaccacccugaacaacgugcacagcgacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcaacgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171676 - RNA, 1410 nt, Artificial Sequence
  derived and/or modified sequence opt4 from neuraminidase__InfluenzaA__ADK87337
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacgccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcaacgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171677 - RNA, 1410 nt, Artificial Sequence
  derived and/or modified sequence opt4 from neuraminidase__InfluenzaA__ADK87339
augaaccccaaccagaagaucaucaccaucggcagcaucugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171678 - RNA, 1410 nt, Artificial Sequence; identical to SEQ ID NO: 169258
  derived and/or modified sequence opt4 from neuraminidase__InfluenzaA__ADK90209

SEQ ID NO: 171679 - RNA, 1410 nt, Artificial Sequence; identical to SEQ ID NO: 169258
  derived and/or modified sequence opt4 from neuraminidase__InfluenzaA__ADK90213

SEQ ID NO: 171680 - RNA, 1410 nt, Artificial Sequence; identical to SEQ ID NO: 169258
  derived and/or modified sequence opt4 from neuraminidase__InfluenzaA__ADK90217

SEQ ID NO: 171681 - RNA, 1410 nt, Artificial Sequence; identical to SEQ ID NO: 171237
  derived and/or modified sequence opt4 from neuraminidase__InfluenzaA__ADK90221

SEQ ID NO: 171682 - RNA, 1410 nt, Artificial Sequence; identical to SEQ ID NO: 171237
  derived and/or modified sequence opt4 from neuraminidase__InfluenzaA__ADK90225

SEQ ID NO: 171683 - RNA, 1410 nt, Artificial Sequence; identical to SEQ ID NO: 169258
  derived and/or modified sequence opt4 from neuraminidase__InfluenzaA__ADK90229

SEQ ID NO: 171684 - RNA, 1410 nt, Artificial Sequence; identical to SEQ ID NO: 169258
  derived and/or modified sequence opt4 from neuraminidase__InfluenzaA__ADK90233

SEQ ID NO: 171685 - RNA, 1410 nt, Artificial Sequence
  derived and/or modified sequence opt4 from neuraminidase__InfluenzaA__ADK90241
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacgccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171686 - RNA, 1410 nt, Artificial Sequence; identical to SEQ ID NO: 171237
  derived and/or modified sequence opt4 from neuraminidase__InfluenzaA__ADK90245

SEQ ID NO: 171687 - RNA, 1410 nt, Artificial Sequence
  derived and/or modified sequence opt4 from neuraminidase__InfluenzaA__ADK90249
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaugaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171688 - RNA, 1410 nt, Artificial Sequence; identical to SEQ ID NO: 171687
  derived and/or modified sequence opt4 from neuraminidase__InfluenzaA__ADK90253

SEQ ID NO: 171689 - RNA, 1410 nt, Artificial Sequence
  derived and/or modified sequence opt4 from neuraminidase__InfluenzaA__ADK90257
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171690 - RNA, 1410 nt, Artificial Sequence; identical to SEQ ID NO: 169612
  derived and/or modified sequence opt4 from neuraminidase__InfluenzaA__ADK90261

SEQ ID NO: 171691 - RNA, 1410 nt, Artificial Sequence
  derived and/or modified sequence opt4 from neuraminidase__InfluenzaA__ADK90265
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171692 - RNA, 1410 nt, Artificial Sequence
  derived and/or modified sequence opt4 from neuraminidase__InfluenzaA__ADK90269
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaagugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcaucgagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 171693 - RNA, 1410 nt, Artificial Sequence; identical to SEQ ID NO: 169258
  derived and/or modified sequence opt4 from neuraminidase__InfluenzaA__ADK90273

SEQ ID NO: 171694 - RNA, 1410 nt, Artificial Sequence; identical to SEQ ID NO: 169258
  derived and/or modified sequence opt4 from neuraminidase__InfluenzaA__ADK90277

SEQ ID NO: 171695 - RNA, 1410 nt, Artificial Sequence; identical to SEQ ID NO: 169258
  derived and/or modified sequence opt4 from neuraminidase__InfluenzaA__ADK90281

SEQ ID NO: 171696 - RNA, 1410 nt, Artificial Sequence
  derived and/or modified sequence opt4 from neuraminidase__InfluenzaA__ADK90289
augaaccccaaccagaagaucaucaccaucggcagcgugugcaugaccaucggcauggccaaccugauccugcagaucggcaacaucaucagcaucuggaucagccacagcauccagcugggcaaccagaaccugaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171697 - RNA, 1410 nt, Artificial Sequence; identical to SEQ ID NO: 171237
  derived and/or modified sequence opt4 from neuraminidase__InfluenzaA__ADK90293

SEQ ID NO: 171698 - RNA, 1410 nt, Artificial Sequence; identical to SEQ ID NO: 171149
  derived and/or modified sequence opt4 from neuraminidase__InfluenzaA__ADK90297

SEQ ID NO: 171699 - RNA, 1410 nt, Artificial Sequence; identical to SEQ ID NO: 169258
  derived and/or modified sequence opt4 from neuraminidase__InfluenzaA__ADK90301

SEQ ID NO: 171700 - RNA, 1410 nt, Artificial Sequence; identical to SEQ ID NO: 171149
  derived and/or modified sequence opt4 from neuraminidase__InfluenzaA__ADK90305

SEQ ID NO: 171701 - RNA, 1410 nt, Artificial Sequence; identical to SEQ ID NO: 169258
  derived and/or modified sequence opt4 from neuraminidase__InfluenzaA__ADK90309

SEQ ID NO: 171702 - RNA, 1410 nt, Artificial Sequence
  derived and/or modified sequence opt4 from neuraminidase__InfluenzaA__ADK90313
augaaccccaaccacaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171703 - RNA, 1410 nt, Artificial Sequence; identical to SEQ ID NO: 169258
  derived and/or modified sequence opt4 from neuraminidase__InfluenzaA__ADK90317

SEQ ID NO: 171704 - RNA, 1410 nt, Artificial Sequence; identical to SEQ ID NO: 171237
  derived and/or modified sequence opt4 from neuraminidase__InfluenzaA__ADK90321

SEQ ID NO: 171705 - RNA, 1410 nt, Artificial Sequence; identical to SEQ ID NO: 169258
  derived and/or modified sequence opt4 from neuraminidase__InfluenzaA__ADK90325

SEQ ID NO: 171706 - RNA, 1410 nt, Artificial Sequence
  derived and/or modified sequence opt4 from neuraminidase__InfluenzaA__ADK90329
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaacagaagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171707 - RNA, 1410 nt, Artificial Sequence
  derived and/or modified sequence opt4 from neuraminidase__InfluenzaA__ADK90333
augaaccccaaccagaagaucaucaccaucggcagcgugugcaugaccaucggcauggccaaccugauccugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171708 - RNA, 1410 nt, Artificial Sequence; identical to SEQ ID NO: 171237
  derived and/or modified sequence opt4 from neuraminidase__InfluenzaA__ADK90337

SEQ ID NO: 171709 - RNA, 1410 nt, Artificial Sequence; identical to SEQ ID NO: 170317
  derived and/or modified sequence opt4 from neuraminidase__InfluenzaA__ADK90341

SEQ ID NO: 171710 - RNA, 1410 nt, Artificial Sequence; identical to SEQ ID NO: 170317
  derived and/or modified sequence opt4 from neuraminidase__InfluenzaA__ADK90345

SEQ ID NO: 171711 - RNA, 1410 nt, Artificial Sequence; identical to SEQ ID NO: 170317
  derived and/or modified sequence opt4 from neuraminidase__InfluenzaA__ADK90349

SEQ ID NO: 171712 - RNA, 1410 nt, Artificial Sequence; identical to SEQ ID NO: 171237
  derived and/or modified sequence opt4 from neuraminidase__InfluenzaA__ADK90353

SEQ ID NO: 171713 - RNA, 1410 nt, Artificial Sequence; identical to SEQ ID NO: 169258
  derived and/or modified sequence opt4 from neuraminidase__InfluenzaA__ADK90357

SEQ ID NO: 171714 - RNA, 1410 nt, Artificial Sequence; identical to SEQ ID NO: 171237
  derived and/or modified sequence opt4 from neuraminidase__InfluenzaA__ADK90361

SEQ ID NO: 171715 - RNA, 1410 nt, Artificial Sequence; identical to SEQ ID NO: 170232
  derived and/or modified sequence opt4 from neuraminidase__InfluenzaA__ADK90365

SEQ ID NO: 171716 - RNA, 1410 nt, Artificial Sequence; identical to SEQ ID NO: 169258
  derived and/or modified sequence opt4 from neuraminidase__InfluenzaA__ADK90369

SEQ ID NO: 171717 - RNA, 1410 nt, Artificial Sequence; identical to SEQ ID NO: 169258
  derived and/or modified sequence opt4 from neuraminidase__InfluenzaA__ADK90373

SEQ ID NO: 171718 - RNA, 1410 nt, Artificial Sequence
  derived and/or modified sequence opt4 from neuraminidase__InfluenzaA__ADK90377
augaaccccaaccagaagaucaucaccaucggcagcgugugcaugaccaucggcaugaccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagauggacgcccccaacuaccacuacgaggagugcagcugcuaccccgacagcagcgagaucaucugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171719 - RNA, 1410 nt, Artificial Sequence; identical to SEQ ID NO: 171237
  derived and/or modified sequence opt4 from neuraminidase__InfluenzaA__ADK90381

SEQ ID NO: 171720 - RNA, 1410 nt, Artificial Sequence
  derived and/or modified sequence opt4 from neuraminidase__InfluenzaA__ADK90385
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcugagcggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcaccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171721 - RNA, 1410 nt, Artificial Sequence; identical to SEQ ID NO: 169258
  derived and/or modified sequence opt4 from neuraminidase__InfluenzaA__ADK90389

SEQ ID NO: 171722 - RNA, 1410 nt, Artificial Sequence; identical to SEQ ID NO: 171237
  derived and/or modified sequence opt4 from neuraminidase__InfluenzaA__ADK90393

SEQ ID NO: 171723 - RNA, 1410 nt, Artificial Sequence; identical to SEQ ID NO: 171149
  derived and/or modified sequence opt4 from neuraminidase__InfluenzaA__ADK90397

SEQ ID NO: 171724 - RNA, 1410 nt, Artificial Sequence; identical to SEQ ID NO: 169258
  derived and/or modified sequence opt4 from neuraminidase__InfluenzaA__ADK90401

SEQ ID NO: 171725 - RNA, 1410 nt, Artificial Sequence
  derived and/or modified sequence opt4 from neuraminidase__InfluenzaA__ADK90405
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcaccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171726 - RNA, 1410 nt, Artificial Sequence; identical to SEQ ID NO: 169258
  derived and/or modified sequence opt4 from neuraminidase__InfluenzaA__ADK90409

SEQ ID NO: 171727 - RNA, 1410 nt, Artificial Sequence
  derived and/or modified sequence opt4 from neuraminidase__InfluenzaA__ADK90413
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccauggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171728 - RNA, 1410 nt, Artificial Sequence; identical to SEQ ID NO: 169258
  derived and/or modified sequence opt4 from neuraminidase__InfluenzaA__ADK90417

SEQ ID NO: 171729 - RNA, 1410 nt, Artificial Sequence; identical to SEQ ID NO: 169258
  derived and/or modified sequence opt4 from neuraminidase__InfluenzaA__ADK90421

SEQ ID NO: 171730 - RNA, 1410 nt, Artificial Sequence; identical to SEQ ID NO: 169258
  derived and/or modified sequence opt4 from neuraminidase__InfluenzaA__ADK90425

SEQ ID NO: 171731 - RNA, 1410 nt, Artificial Sequence; identical to SEQ ID NO: 169258
  derived and/or modified sequence opt4 from neuraminidase__InfluenzaA__ADK90429

SEQ ID NO: 171732 - RNA, 1410 nt, Artificial Sequence; identical to SEQ ID NO: 169119
  derived and/or modified sequence opt4 from neuraminidase__InfluenzaA__ADK94194

SEQ ID NO: 171733 - RNA, 1410 nt, Artificial Sequence; identical to SEQ ID NO: 169119
  derived and/or modified sequence opt4 from neuraminidase__InfluenzaA__ADK94205

SEQ ID NO: 171734 - RNA, 1410 nt, Artificial Sequence; identical to SEQ ID NO: 170425
  derived and/or modified sequence opt4 from neuraminidase__InfluenzaA__ADK94216

SEQ ID NO: 171735 - RNA, 1410 nt, Artificial Sequence; identical to SEQ ID NO: 169119
  derived and/or modified sequence opt4 from neuraminidase__InfluenzaA__ADK94227

SEQ ID NO: 171736 - RNA, 1410 nt, Artificial Sequence; identical to SEQ ID NO: 169119
  derived and/or modified sequence opt4 from neuraminidase__InfluenzaA__ADK94238

SEQ ID NO: 171737 - RNA, 1410 nt, Artificial Sequence; identical to SEQ ID NO: 171643
  derived and/or modified sequence opt4 from neuraminidase__InfluenzaA__ADK94260

SEQ ID NO: 171738 - RNA, 1410 nt, Artificial Sequence; identical to SEQ ID NO: 171643
  derived and/or modified sequence opt4 from neuraminidase__InfluenzaA__ADK94271

SEQ ID NO: 171739 - RNA, 1410 nt, Artificial Sequence; identical to SEQ ID NO: 169119
  derived and/or modified sequence opt4 from neuraminidase__InfluenzaA__ADK94293

SEQ ID NO: 171740 - RNA, 1410 nt, Artificial Sequence; identical to SEQ ID NO: 169119
  derived and/or modified sequence opt4 from neuraminidase__InfluenzaA__ADK94304

SEQ ID NO: 171741 - RNA, 1410 nt, Artificial Sequence
  derived and/or modified sequence opt4 from neuraminidase__InfluenzaA__ADK94326
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacauccacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171742 - RNA, 1410 nt, Artificial Sequence; identical to SEQ ID NO: 170425
  derived and/or modified sequence opt4 from neuraminidase__InfluenzaA__ADK94337

SEQ ID NO: 171743 - RNA, 1410 nt, Artificial Sequence; identical to SEQ ID NO: 169119
  derived and/or modified sequence opt4 from neuraminidase__InfluenzaA__ADK94444

SEQ ID NO: 171744 - RNA, 1410 nt, Artificial Sequence
  derived and/or modified sequence opt4 from neuraminidase__InfluenzaA__ADK94479
augaaccccaaccagaagaucaucaccaucggcagcgugagccugaccaucagcaccaucugcuuccugaugcagaucgccauccugaccaccaccgugacccugcacuucaagcaguacgaguucaacagcccccccaacaaccaggugaugcugugcgagcccaccaccaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuaccugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccggcgugcuguggaccagcaacagcaucgugguguucugcggcaccagcggcaccuacggcaccggcagcuggcccgacggcgccgacaucaaccugaugcccaucuga

SEQ ID NO: 171745 - RNA, 1410 nt, Artificial Sequence; identical to SEQ ID NO: 169119
  derived and/or modified sequence opt4 from neuraminidase__InfluenzaA__ADK94490

SEQ ID NO: 171746 - RNA, 1410 nt, Artificial Sequence; identical to SEQ ID NO: 169119
  derived and/or modified sequence opt4 from neuraminidase__InfluenzaA__ADK94501

SEQ ID NO: 171747 - RNA, 1410 nt, Artificial Sequence
  derived and/or modified sequence opt4 from neuraminidase__InfluenzaA__ADK94512
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcagaaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171748 - RNA, 1410 nt, Artificial Sequence; identical to SEQ ID NO: 169119
  derived and/or modified sequence opt4 from neuraminidase__InfluenzaA__ADK94534

SEQ ID NO: 171749 - RNA, 1410 nt, Artificial Sequence; identical to SEQ ID NO: 171643
  derived and/or modified sequence opt4 from neuraminidase__InfluenzaA__ADK94556

SEQ ID NO: 171750 - RNA, 1410 nt, Artificial Sequence; identical to SEQ ID NO: 169119
  derived and/or modified sequence opt4 from neuraminidase__InfluenzaA__ADK94567

SEQ ID NO: 171751 - RNA, 1410 nt, Artificial Sequence; identical to SEQ ID NO: 169119
  derived and/or modified sequence opt4 from neuraminidase__InfluenzaA__ADK94578

SEQ ID NO: 171752 - RNA, 1410 nt, Artificial Sequence; identical to SEQ ID NO: 169119
  derived and/or modified sequence opt4 from neuraminidase__InfluenzaA__ADK94589

SEQ ID NO: 171753 - RNA, 1410 nt, Artificial Sequence; identical to SEQ ID NO: 170809
  derived and/or modified sequence opt4 from neuraminidase__InfluenzaA__ADK98504

SEQ ID NO: 171754 - RNA, 1410 nt, Artificial Sequence
  derived and/or modified sequence opt4 from neuraminidase__InfluenzaA__ADK98506
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagaacgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171755 - RNA, 1410 nt, Artificial Sequence
  derived and/or modified sequence opt4 from neuraminidase__InfluenzaA__ADK98626
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaugaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuaccugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171756 - RNA, 1410 nt, Artificial Sequence; identical to SEQ ID NO: 170425
  derived and/or modified sequence opt4 from neuraminidase__InfluenzaA__ADK98637

SEQ ID NO: 171757 - RNA, 1410 nt, Artificial Sequence
  derived and/or modified sequence opt4 from neuraminidase__InfluenzaA__ADK98648
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggcagaggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171758 - RNA, 1410 nt, Artificial Sequence
  derived and/or modified sequence opt4 from neuraminidase__InfluenzaA__ADK98659
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 171759 - RNA, 1410 nt, Artificial Sequence; identical to SEQ ID NO: 171643
  derived and/or modified sequence opt4 from neuraminidase__InfluenzaA__ADK98670

SEQ ID NO: 171760 - RNA, 1410 nt, Artificial Sequence
  derived and/or modified sequence opt4 from neuraminidase__InfluenzaA__ADK98681
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaccaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171761 - RNA, 1410 nt, Artificial Sequence
  derived and/or modified sequence opt4 from neuraminidase__InfluenzaA__ADK98703
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaccaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171762 - RNA, 1410 nt, Artificial Sequence; identical to SEQ ID NO: 171004
  derived and/or modified sequence opt4 from neuraminidase__InfluenzaA__ADK98725

SEQ ID NO: 171763 - RNA, 1410 nt, Artificial Sequence; identical to SEQ ID NO: 171643
  derived and/or modified sequence opt4 from neuraminidase__InfluenzaA__ADK98736

SEQ ID NO: 171764 - RNA, 1410 nt, Artificial Sequence
  derived and/or modified sequence opt4 from neuraminidase__InfluenzaA__ADK98747
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171765 - RNA, 1410 nt, Artificial Sequence
  derived and/or modified sequence opt4 from neuraminidase__InfluenzaA__ADK98758
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccaacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171766 - RNA, 1410 nt, Artificial Sequence; identical to SEQ ID NO: 171004
  derived and/or modified sequence opt4 from neuraminidase__InfluenzaA__ADK98769

SEQ ID NO: 171767 - RNA, 1410 nt, Artificial Sequence; identical to SEQ ID NO: 171558
  derived and/or modified sequence opt4 from neuraminidase__InfluenzaA__ADK98780

SEQ ID NO: 171768 - RNA, 1410 nt, Artificial Sequence; identical to SEQ ID NO: 171004
  derived and/or modified sequence opt4 from neuraminidase__InfluenzaA__ADK98791

SEQ ID NO: 171769 - RNA, 1410 nt, Artificial Sequence; identical to SEQ ID NO: 169119
  derived and/or modified sequence opt4 from neuraminidase__InfluenzaA__ADK98802

SEQ ID NO: 171770 - RNA, 1410 nt, Artificial Sequence
  derived and/or modified sequence opt4 from neuraminidase__InfluenzaA__ADK98813
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 171771 - RNA, 1410 nt, Artificial Sequence; identical to SEQ ID NO: 169119
  derived and/or modified sequence opt4 from neuraminidase__InfluenzaA__ADK98824

SEQ ID NO: 171772 - RNA, 1410 nt, Artificial Sequence; identical to SEQ ID NO: 171004
  derived and/or modified sequence opt4 from neuraminidase__InfluenzaA__ADK98835

SEQ ID NO: 171773 - RNA, 1410 nt, Artificial Sequence; identical to SEQ ID NO: 171643
  derived and/or modified sequence opt4 from neuraminidase__InfluenzaA__ADK98846

SEQ ID NO: 171774 - RNA, 1410 nt, Artificial Sequence
  derived and/or modified sequence opt4 from neuraminidase__InfluenzaA__ADK98857
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171775 - RNA, 1410 nt, Artificial Sequence
  derived and/or modified sequence opt4 from neuraminidase__InfluenzaA__ADK98868
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 171776 - RNA, 1410 nt, Artificial Sequence
  derived and/or modified sequence opt4 from neuraminidase__InfluenzaA__ADK98879
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggccaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171777 - RNA, 1410 nt, Artificial Sequence; identical to SEQ ID NO: 171643
  derived and/or modified sequence opt4 from neuraminidase__InfluenzaA__ADK98890

SEQ ID NO: 171778 - RNA, 1410 nt, Artificial Sequence; identical to SEQ ID NO: 171004
  derived and/or modified sequence opt4 from neuraminidase__InfluenzaA__ADK98901

SEQ ID NO: 171779 - RNA, 1410 nt, Artificial Sequence; identical to SEQ ID NO: 171558
  derived and/or modified sequence opt4 from neuraminidase__InfluenzaA__ADK98912

SEQ ID NO: 171780 - RNA, 1410 nt, Artificial Sequence; identical to SEQ ID NO: 171643
  derived and/or modified sequence opt4 from neuraminidase__InfluenzaA__ADK98923

SEQ ID NO: 171781 - RNA, 1410 nt, Artificial Sequence; identical to SEQ ID NO: 170425
  derived and/or modified sequence opt4 from neuraminidase__InfluenzaA__ADK98945

SEQ ID NO: 171782 - RNA, 1410 nt, Artificial Sequence
  derived and/or modified sequence opt4 from neuraminidase__InfluenzaA__ADK98956
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcguggugagcagcuacgugugcagcggccuggugggcgacacccccagaaagagcgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 171783 - RNA, 1410 nt, Artificial Sequence; identical to SEQ ID NO: 171004
  derived and/or modified sequence opt4 from neuraminidase__InfluenzaA__ADK98967

SEQ ID NO: 171784 - RNA, 1410 nt, Artificial Sequence; identical to SEQ ID NO: 171643
  derived and/or modified sequence opt4 from neuraminidase__InfluenzaA__ADK98978

SEQ ID NO: 171785 - RNA, 1410 nt, Artificial Sequence; identical to SEQ ID NO: 171782
  derived and/or modified sequence opt4 from neuraminidase__InfluenzaA__ADK98989

SEQ ID NO: 171786 - RNA, 1410 nt, Artificial Sequence; identical to SEQ ID NO: 169119
  derived and/or modified sequence opt4 from neuraminidase__InfluenzaA__ADK99000

SEQ ID NO: 171787 - RNA, 1410 nt, Artificial Sequence; identical to SEQ ID NO: 171782
  derived and/or modified sequence opt4 from neuraminidase__InfluenzaA__ADK99011

SEQ ID NO: 171788 - RNA, 1410 nt, Artificial Sequence
  derived and/or modified sequence opt4 from neuraminidase__InfluenzaA__ADK99022
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgaccccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171789 - RNA, 1410 nt, Artificial Sequence; identical to SEQ ID NO: 169119
  derived and/or modified sequence opt4 from neuraminidase__InfluenzaA__ADK99033

SEQ ID NO: 171790 - RNA, 1410 nt, Artificial Sequence
  derived and/or modified sequence opt4 from neuraminidase__InfluenzaA__ADK99044
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaagaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 171791 - RNA, 1410 nt, Artificial Sequence
  derived and/or modified sequence opt4 from neuraminidase__InfluenzaA__ADK99055
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171792 - RNA, 1410 nt, Artificial Sequence
  derived and/or modified sequence opt4 from neuraminidase__InfluenzaA__ADK99066
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaagaagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuaccugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171793 - RNA, 1410 nt, Artificial Sequence
  derived and/or modified sequence opt4 from neuraminidase__InfluenzaA__ADK99077
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagguggugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 171794 - RNA, 1410 nt, Artificial Sequence; identical to SEQ ID NO: 171558
  derived and/or modified sequence opt4 from neuraminidase__InfluenzaA__ADK99088

SEQ ID NO: 171795 - RNA, 1410 nt, Artificial Sequence; identical to SEQ ID NO: 171004
  derived and/or modified sequence opt4 from neuraminidase__InfluenzaA__ADK99099

SEQ ID NO: 171796 - RNA, 1410 nt, Artificial Sequence
  derived and/or modified sequence opt4 from neuraminidase__InfluenzaA__ADK99110
augaaccccaaccagaagaucaucaccaucggcagcgugagccugaccaucagcaccaucugcuucuucaugcagaucgccauccuggugaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171797 - RNA, 1410 nt, Artificial Sequence; identical to SEQ ID NO: 171643
  derived and/or modified sequence opt4 from neuraminidase__InfluenzaA__ADK99121

SEQ ID NO: 171798 - RNA, 1410 nt, Artificial Sequence
  derived and/or modified sequence opt4 from neuraminidase__InfluenzaA__ADK99132
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccguggagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuaccugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171799 - RNA, 1410 nt, Artificial Sequence; identical to SEQ ID NO: 171643
  derived and/or modified sequence opt4 from neuraminidase__InfluenzaA__ADK99143

SEQ ID NO: 171800 - RNA, 1410 nt, Artificial Sequence; identical to SEQ ID NO: 169119
  derived and/or modified sequence opt4 from neuraminidase__InfluenzaA__ADK99154

SEQ ID NO: 171801 - RNA, 1410 nt, Artificial Sequence
  derived and/or modified sequence opt4 from neuraminidase__InfluenzaA__ADK99176
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccugaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171802 - RNA, 1410 nt, Artificial Sequence; identical to SEQ ID NO: 171793
  derived and/or modified sequence opt4 from neuraminidase__InfluenzaA__ADK99187

SEQ ID NO: 171803 - RNA, 1410 nt, Artificial Sequence; identical to SEQ ID NO: 171004
  derived and/or modified sequence opt4 from neuraminidase__InfluenzaA__ADK99198

SEQ ID NO: 171804 - RNA, 1410 nt, Artificial Sequence; identical to SEQ ID NO: 171643
  derived and/or modified sequence opt4 from neuraminidase__InfluenzaA__ADK99220

SEQ ID NO: 171805 - RNA, 1410 nt, Artificial Sequence
  derived and/or modified sequence opt4 from neuraminidase__InfluenzaA__ADK99231
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaacugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuaccugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171806 - RNA, 1410 nt, Artificial Sequence
  derived and/or modified sequence opt4 from neuraminidase__InfluenzaA__ADK99242
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucaucguguucugcggcaccagcggcaccuacggcaccggcagcuggcccgacggcgccgacaucaaccugaugcccaucuga

SEQ ID NO: 171807 - RNA, 1410 nt, Artificial Sequence
  derived and/or modified sequence opt4 from neuraminidase__InfluenzaA__ADK99253
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggccacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugacccugaugcccaucuga

SEQ ID NO: 171808 - RNA, 1410 nt, Artificial Sequence
  derived and/or modified sequence opt4 from neuraminidase__InfluenzaA__ADK99264
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuaccugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcacaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171809 - RNA, 1410 nt, Artificial Sequence
  derived and/or modified sequence opt4 from neuraminidase__InfluenzaA__ADK99275
augaaccccaaccagaagaucaucaccaucggcagcgugagccugaccaucagcaccaucugcuucuucaugcagaucgccgugcugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccggcuacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 171810 - RNA, 1410 nt, Artificial Sequence
  derived and/or modified sequence opt4 from neuraminidase__InfluenzaA__ADK99286
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugacccccagagagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacauccacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171811 - RNA, 1410 nt, Artificial Sequence; identical to SEQ ID NO: 170112
  derived and/or modified sequence opt4 from neuraminidase__InfluenzaA__ADK99297

SEQ ID NO: 171812 - RNA, 1410 nt, Artificial Sequence
  derived and/or modified sequence opt4 from neuraminidase__InfluenzaA__ADK99308
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcauccccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171813 - RNA, 1413 nt, Artificial Sequence; identical to SEQ ID NO: 169981
  derived and/or modified sequence opt4 from neuraminidase__InfluenzaA__ADL14590

SEQ ID NO: 171814 - RNA, 1410 nt, Artificial Sequence; identical to SEQ ID NO: 171004
  derived and/or modified sequence opt4 from neuraminidase__InfluenzaA__ADL27992

SEQ ID NO: 171815 - RNA, 1410 nt, Artificial Sequence; identical to SEQ ID NO: 171643
  derived and/or modified sequence opt4 from neuraminidase__InfluenzaA__ADL28003

SEQ ID NO: 171816 - RNA, 1410 nt, Artificial Sequence; identical to SEQ ID NO: 171788
  derived and/or modified sequence opt4 from neuraminidase__InfluenzaA__ADL28014

SEQ ID NO: 171817 - RNA, 1410 nt, Artificial Sequence
  derived and/or modified sequence opt4 from neuraminidase__InfluenzaA__ADL28025
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaagaagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuaccugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171818 - RNA, 1410 nt, Artificial Sequence; identical to SEQ ID NO: 171004
  derived and/or modified sequence opt4 from neuraminidase__InfluenzaA__ADL28036

SEQ ID NO: 171819 - RNA, 1410 nt, Artificial Sequence; identical to SEQ ID NO: 169119
  derived and/or modified sequence opt4 from neuraminidase__InfluenzaA__ADL28047

SEQ ID NO: 171820 - RNA, 1410 nt, Artificial Sequence; identical to SEQ ID NO: 170425
  derived and/or modified sequence opt4 from neuraminidase__InfluenzaA__ADL28058

SEQ ID NO: 171821 - RNA, 1410 nt, Artificial Sequence; identical to SEQ ID NO: 171796
  derived and/or modified sequence opt4 from neuraminidase__InfluenzaA__ADL28069

SEQ ID NO: 171822 - RNA, 1410 nt, Artificial Sequence; identical to SEQ ID NO: 171643
  derived and/or modified sequence opt4 from neuraminidase__InfluenzaA__ADL28080

SEQ ID NO: 171823 - RNA, 1410 nt, Artificial Sequence; identical to SEQ ID NO: 171004
  derived and/or modified sequence opt4 from neuraminidase__InfluenzaA__ADL28091

SEQ ID NO: 171824 - RNA, 1410 nt, Artificial Sequence
  derived and/or modified sequence opt4 from neuraminidase__InfluenzaA__ADL28102
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171825 - RNA, 1410 nt, Artificial Sequence; identical to SEQ ID NO: 169119
  derived and/or modified sequence opt4 from neuraminidase__InfluenzaA__ADL28113

SEQ ID NO: 171826 - RNA, 1410 nt, Artificial Sequence
  derived and/or modified sequence opt4 from neuraminidase__InfluenzaA__ADL28129
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgagauccuguggaccagcaacagcaucgugguguucugcggcaccagcggcaccuacggcaccggcagcuggcccgacggcgccaacaucaaccugaugcccaucuga

SEQ ID NO: 171827 - RNA, 1410 nt, Artificial Sequence
  derived and/or modified sequence opt4 from neuraminidase__InfluenzaA__ADL28140
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 171828 - RNA, 1410 nt, Artificial Sequence; identical to SEQ ID NO: 171004
  derived and/or modified sequence opt4 from neuraminidase__InfluenzaA__ADL28151

SEQ ID NO: 171829 - RNA, 1410 nt, Artificial Sequence; identical to SEQ ID NO: 170425
  derived and/or modified sequence opt4 from neuraminidase__InfluenzaA__ADL28162

SEQ ID NO: 171830 - RNA, 1410 nt, Artificial Sequence; identical to SEQ ID NO: 171643
  derived and/or modified sequence opt4 from neuraminidase__InfluenzaA__ADL28173

SEQ ID NO: 171831 - RNA, 1410 nt, Artificial Sequence; identical to SEQ ID NO: 171004
  derived and/or modified sequence opt4 from neuraminidase__InfluenzaA__ADL28184

SEQ ID NO: 171832 - RNA, 1410 nt, Artificial Sequence
  derived and/or modified sequence opt4 from neuraminidase__InfluenzaA__ADL28195
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcgugaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171833 - RNA, 1410 nt, Artificial Sequence; identical to SEQ ID NO: 171793
  derived and/or modified sequence opt4 from neuraminidase__InfluenzaA__ADL28206

SEQ ID NO: 171834 - RNA, 1410 nt, Artificial Sequence; identical to SEQ ID NO: 170112
  derived and/or modified sequence opt4 from neuraminidase__InfluenzaA__ADL28217

SEQ ID NO: 171835 - RNA, 1410 nt, Artificial Sequence; identical to SEQ ID NO: 171004
  derived and/or modified sequence opt4 from neuraminidase__InfluenzaA__ADL28228

SEQ ID NO: 171836 - RNA, 1410 nt, Artificial Sequence; identical to SEQ ID NO: 171643
  derived and/or modified sequence opt4 from neuraminidase__InfluenzaA__ADL28239

SEQ ID NO: 171837 - RNA, 1410 nt, Artificial Sequence; identical to SEQ ID NO: 170425
  derived and/or modified sequence opt4 from neuraminidase__InfluenzaA__ADL28250

SEQ ID NO: 171838 - RNA, 1410 nt, Artificial Sequence; identical to SEQ ID NO: 171643
  derived and/or modified sequence opt4 from neuraminidase__InfluenzaA__ADL28261

SEQ ID NO: 171839 - RNA, 1410 nt, Artificial Sequence; identical to SEQ ID NO: 171004
  derived and/or modified sequence opt4 from neuraminidase__InfluenzaA__ADL28373

SEQ ID NO: 171840 - RNA, 1410 nt, Artificial Sequence; identical to SEQ ID NO: 169123
  derived and/or modified sequence opt4 from neuraminidase__InfluenzaA__ADL28387

SEQ ID NO: 171841 - RNA, 1410 nt, Artificial Sequence
  derived and/or modified sequence opt4 from neuraminidase__InfluenzaA__ADL28391
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagugcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171842 - RNA, 1410 nt, Artificial Sequence
  derived and/or modified sequence opt4 from neuraminidase__InfluenzaA__ADL28395
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagugcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 171843 - RNA, 1410 nt, Artificial Sequence; identical to SEQ ID NO: 169258
  derived and/or modified sequence opt4 from neuraminidase__InfluenzaA__ADL29675

SEQ ID NO: 171844 - RNA, 1410 nt, Artificial Sequence; identical to SEQ ID NO: 169258
  derived and/or modified sequence opt4 from neuraminidase__InfluenzaA__ADL29685

SEQ ID NO: 171845 - RNA, 1410 nt, Artificial Sequence
  derived and/or modified sequence opt4 from neuraminidase__InfluenzaA__ADL29695
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaucgugggcuggagcuggcccgacggcgccgagcugcccuucaccaucgacaaguga

SEQ ID NO: 171846 - RNA, 1410 nt, Artificial Sequence; identical to SEQ ID NO: 169258
  derived and/or modified sequence opt4 from neuraminidase__InfluenzaA__ADL29705

SEQ ID NO: 171847 - RNA, 1410 nt, Artificial Sequence; identical to SEQ ID NO: 171845
  derived and/or modified sequence opt4 from neuraminidase__InfluenzaA__ADL29733

SEQ ID NO: 171848 - RNA, 1410 nt, Artificial Sequence; identical to SEQ ID NO: 169258
  derived and/or modified sequence opt4 from neuraminidase__InfluenzaA__ADL29743

SEQ ID NO: 171849 - RNA, 1410 nt, Artificial Sequence
  derived and/or modified sequence opt4 from neuraminidase__InfluenzaA__ADL29753
augaaccccaaccagaagaucaucaccaucggcagcgugugcauggccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaucgugggcuggagcuggcccgacggcgccgagcugcccuucaccaucgacaaguga

SEQ ID NO: 171850 - RNA, 1410 nt, Artificial Sequence; identical to SEQ ID NO: 169258
  derived and/or modified sequence opt4 from neuraminidase__InfluenzaA__ADL29763

SEQ ID NO: 171851 - RNA, 1410 nt, Artificial Sequence; identical to SEQ ID NO: 171845
  derived and/or modified sequence opt4 from neuraminidase__InfluenzaA__ADL29773

SEQ ID NO: 171852 - RNA, 1410 nt, Artificial Sequence; identical to SEQ ID NO: 169258
  derived and/or modified sequence opt4 from neuraminidase__InfluenzaA__ADL29783

SEQ ID NO: 171853 - RNA, 1410 nt, Artificial Sequence; identical to SEQ ID NO: 171845
  derived and/or modified sequence opt4 from neuraminidase__InfluenzaA__ADL29882

SEQ ID NO: 171854 - RNA, 1410 nt, Artificial Sequence
  derived and/or modified sequence opt4 from neuraminidase__InfluenzaA__ADL32020
augaaccccaaccagaagaucaucaccaucggcagcgugugcaugaccaucggcauggccaaccugauccugcagaucggcaacaucaucagcaccuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171855 - RNA, 1410 nt, Artificial Sequence; identical to SEQ ID NO: 171845
  derived and/or modified sequence opt4 from neuraminidase__InfluenzaA__ADL32030

SEQ ID NO: 171856 - RNA, 1410 nt, Artificial Sequence; identical to SEQ ID NO: 169258
  derived and/or modified sequence opt4 from neuraminidase__InfluenzaA__ADL32040

SEQ ID NO: 171857 - RNA, 1410 nt, Artificial Sequence; identical to SEQ ID NO: 169258
  derived and/or modified sequence opt4 from neuraminidase__InfluenzaA__ADL32050

SEQ ID NO: 171858 - RNA, 1410 nt, Artificial Sequence; identical to SEQ ID NO: 169258
  derived and/or modified sequence opt4 from neuraminidase__InfluenzaA__ADL32060

SEQ ID NO: 171859 - RNA, 1410 nt, Artificial Sequence; identical to SEQ ID NO: 169258
  derived and/or modified sequence opt4 from neuraminidase__InfluenzaA__ADL32093

SEQ ID NO: 171860 - RNA, 1410 nt, Artificial Sequence; identical to SEQ ID NO: 169258
  derived and/or modified sequence opt4 from neuraminidase__InfluenzaA__ADL32117

SEQ ID NO: 171861 - RNA, 1410 nt, Artificial Sequence; identical to SEQ ID NO: 169258
  derived and/or modified sequence opt4 from neuraminidase__InfluenzaA__ADL32347

SEQ ID NO: 171862 - RNA, 1410 nt, Artificial Sequence
  derived and/or modified sequence opt4 from neuraminidase__InfluenzaA__ADL32357
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccguggacaaguga

SEQ ID NO: 171863 - RNA, 1410 nt, Artificial Sequence; identical to SEQ ID NO: 169258
  derived and/or modified sequence opt4 from neuraminidase__InfluenzaA__ADL32367

SEQ ID NO: 171864 - RNA, 1410 nt, Artificial Sequence; identical to SEQ ID NO: 169258
  derived and/or modified sequence opt4 from neuraminidase__InfluenzaA__ADL32377

SEQ ID NO: 171865 - RNA, 1410 nt, Artificial Sequence; identical to SEQ ID NO: 169258
  derived and/or modified sequence opt4 from neuraminidase__InfluenzaA__ADL32387

SEQ ID NO: 171866 - RNA, 1410 nt, Artificial Sequence; identical to SEQ ID NO: 169258
  derived and/or modified sequence opt4 from neuraminidase__InfluenzaA__ADL32397

SEQ ID NO: 171867 - RNA, 1410 nt, Artificial Sequence; identical to SEQ ID NO: 169258
  derived and/or modified sequence opt4 from neuraminidase__InfluenzaA__ADL32407

SEQ ID NO: 171868 - RNA, 1410 nt, Artificial Sequence; identical to SEQ ID NO: 169258
  derived and/or modified sequence opt4 from neuraminidase__InfluenzaA__ADL32417

SEQ ID NO: 171869 - RNA, 1410 nt, Artificial Sequence
  derived and/or modified sequence opt4 from neuraminidase__InfluenzaA__ADL32427
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaagaccaucuggaccagcggcagcaucaucagcuucugcggcgugaacagcgacaccgugggcuggagcuggcccgacggcgccgagcugcccuucaccaucgacaaguga

SEQ ID NO: 171870 - RNA, 1410 nt, Artificial Sequence; identical to SEQ ID NO: 169258
  derived and/or modified sequence opt4 from neuraminidase__InfluenzaA__ADL32447

SEQ ID NO: 171871 - RNA, 1410 nt, Artificial Sequence
  derived and/or modified sequence opt4 from neuraminidase__InfluenzaA__ADL32457
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaagagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugagcagcgacaccgugggcuggagcuggcccgacggcgccgagcugcccuucaccaucgacaaguga

SEQ ID NO: 171872 - RNA, 1410 nt, Artificial Sequence; identical to SEQ ID NO: 170435
  derived and/or modified sequence opt4 from neuraminidase__InfluenzaA__ADL32487

SEQ ID NO: 171873 - RNA, 1410 nt, Artificial Sequence; identical to SEQ ID NO: 169258
  derived and/or modified sequence opt4 from neuraminidase__InfluenzaA__ADL32497

SEQ ID NO: 171874 - RNA, 1410 nt, Artificial Sequence; identical to SEQ ID NO: 169258
  derived and/or modified sequence opt4 from neuraminidase__InfluenzaA__ADL32507

SEQ ID NO: 171875 - RNA, 1410 nt, Artificial Sequence; identical to SEQ ID NO: 170720
  derived and/or modified sequence opt4 from neuraminidase__InfluenzaA__ADL32517

SEQ ID NO: 171876 - RNA, 1410 nt, Artificial Sequence; identical to SEQ ID NO: 170435
  derived and/or modified sequence opt4 from neuraminidase__InfluenzaA__ADL32527

SEQ ID NO: 171877 - RNA, 1410 nt, Artificial Sequence; identical to SEQ ID NO: 169258
  derived and/or modified sequence opt4 from neuraminidase__InfluenzaA__ADL32537

SEQ ID NO: 171878 - RNA, 1410 nt, Artificial Sequence; identical to SEQ ID NO: 170145
  derived and/or modified sequence opt4 from neuraminidase__InfluenzaA__ADL32547

SEQ ID NO: 171879 - RNA, 1410 nt, Artificial Sequence; identical to SEQ ID NO: 170609
  derived and/or modified sequence opt4 from neuraminidase__InfluenzaA__ADL32673

SEQ ID NO: 171880 - RNA, 1410 nt, Artificial Sequence; identical to SEQ ID NO: 169258
  derived and/or modified sequence opt4 from neuraminidase__InfluenzaA__ADL32683

SEQ ID NO: 171881 - RNA, 1410 nt, Artificial Sequence; identical to SEQ ID NO: 169248
  derived and/or modified sequence opt4 from neuraminidase__InfluenzaA__ADL32693

SEQ ID NO: 171882 - RNA, 1410 nt, Artificial Sequence; identical to SEQ ID NO: 170481
  derived and/or modified sequence opt4 from neuraminidase__InfluenzaA__ADL32703

SEQ ID NO: 171883 - RNA, 1410 nt, Artificial Sequence; identical to SEQ ID NO: 169248
  derived and/or modified sequence opt4 from neuraminidase__InfluenzaA__ADL32713

SEQ ID NO: 171884 - RNA, 1410 nt, Artificial Sequence; identical to SEQ ID NO: 169258
  derived and/or modified sequence opt4 from neuraminidase__InfluenzaA__ADL32723

SEQ ID NO: 171885 - RNA, 1410 nt, Artificial Sequence; identical to SEQ ID NO: 170939
  derived and/or modified sequence opt4 from neuraminidase__InfluenzaA__ADL32733

SEQ ID NO: 171886 - RNA, 1410 nt, Artificial Sequence; identical to SEQ ID NO: 170939
  derived and/or modified sequence opt4 from neuraminidase__InfluenzaA__ADL32743

SEQ ID NO: 171887 - RNA, 1410 nt, Artificial Sequence
  derived and/or modified sequence opt4 from neuraminidase__InfluenzaA__ADL39139
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugagcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagagagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171888 - RNA, 1413 nt, Artificial Sequence
  derived and/or modified sequence opt4 from neuraminidase__InfluenzaA__ADL39150
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171889 - RNA, 1410 nt, Artificial Sequence
  derived and/or modified sequence opt4 from neuraminidase__InfluenzaA__ADL39172
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171890 - RNA, 1410 nt, Artificial Sequence; identical to SEQ ID NO: 169119
  derived and/or modified sequence opt4 from neuraminidase__InfluenzaA__ADL39183

SEQ ID NO: 171891 - RNA, 1413 nt, Artificial Sequence; identical to SEQ ID NO: 171450
  derived and/or modified sequence opt4 from neuraminidase__InfluenzaA__ADL39194

SEQ ID NO: 171892 - RNA, 1410 nt, Artificial Sequence; identical to SEQ ID NO: 169119
  derived and/or modified sequence opt4 from neuraminidase__InfluenzaA__ADL39205

SEQ ID NO: 171893 - RNA, 1413 nt, Artificial Sequence; identical to SEQ ID NO: 169981
  derived and/or modified sequence opt4 from neuraminidase__InfluenzaA__ADL39227

SEQ ID NO: 171894 - RNA, 1413 nt, Artificial Sequence; identical to SEQ ID NO: 171450
  derived and/or modified sequence opt4 from neuraminidase__InfluenzaA__ADL39238

SEQ ID NO: 171895 - RNA, 1413 nt, Artificial Sequence; identical to SEQ ID NO: 171450
  derived and/or modified sequence opt4 from neuraminidase__InfluenzaA__ADL39249

SEQ ID NO: 171896 - RNA, 1413 nt, Artificial Sequence; identical to SEQ ID NO: 169981
  derived and/or modified sequence opt4 from neuraminidase__InfluenzaA__ADL39260

SEQ ID NO: 171897 - RNA, 1410 nt, Artificial Sequence
  derived and/or modified sequence opt4 from neuraminidase__InfluenzaA__ADL39282
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagaagaacaucaccgagaucguguaccugaccaacaccaccaucgagaaggagaucugccccagacuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaaggugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171898 - RNA, 1413 nt, Artificial Sequence; identical to SEQ ID NO: 169981
  derived and/or modified sequence opt4 from neuraminidase__InfluenzaA__ADL39293

SEQ ID NO: 171899 - RNA, 1410 nt, Artificial Sequence
  derived and/or modified sequence opt4 from neuraminidase__InfluenzaA__ADL39304
augaaccccaaccagaagaucaucaccaucggcagcgugagccugaccaucagcaccaucugcuucuucaugcagaucgccauccugaucaccaccgugacccugcacuucaagcaguacgaguucaacuucccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171900 - RNA, 1410 nt, Artificial Sequence; identical to SEQ ID NO: 169119
  derived and/or modified sequence opt4 from neuraminidase__InfluenzaA__ADL39326

SEQ ID NO: 171901 - RNA, 1413 nt, Artificial Sequence; identical to SEQ ID NO: 171450
  derived and/or modified sequence opt4 from neuraminidase__InfluenzaA__ADL39392

SEQ ID NO: 171902 - RNA, 1410 nt, Artificial Sequence
  derived and/or modified sequence opt4 from neuraminidase__InfluenzaA__ADL39403
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 171903 - RNA, 1413 nt, Artificial Sequence; identical to SEQ ID NO: 169981
  derived and/or modified sequence opt4 from neuraminidase__InfluenzaA__ADL39425

SEQ ID NO: 171904 - RNA, 1413 nt, Artificial Sequence
  derived and/or modified sequence opt4 from neuraminidase__InfluenzaA__ADL39447
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccugaccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171905 - RNA, 1413 nt, Artificial Sequence; identical to SEQ ID NO: 169981
  derived and/or modified sequence opt4 from neuraminidase__InfluenzaA__ADL39458

SEQ ID NO: 171906 - RNA, 1413 nt, Artificial Sequence
  derived and/or modified sequence opt4 from neuraminidase__InfluenzaA__ADL39469
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcuggacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171907 - RNA, 1413 nt, Artificial Sequence
  derived and/or modified sequence opt4 from neuraminidase__InfluenzaA__ADL39480
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagauggugugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171908 - RNA, 1410 nt, Artificial Sequence
  derived and/or modified sequence opt4 from neuraminidase__InfluenzaA__ADL39491
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaucgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcagcagcaucgugguguucugcggcaccagcggcaccuacggcaccggcagcuggcccgacggcgccgacaucaaccugaugcccaucuga

SEQ ID NO: 171909 - RNA, 1410 nt, Artificial Sequence; identical to SEQ ID NO: 169258
  derived and/or modified sequence opt4 from neuraminidase__InfluenzaA__ADL41165

SEQ ID NO: 171910 - RNA, 1410 nt, Artificial Sequence
  derived and/or modified sequence opt4 from neuraminidase__InfluenzaA__ADL41175
augaaccccaaccagaagaucaucaccaucggcagcgugugcaugaccaucggcauggccaaccugauccugcagaucggcaacaucaucagcaccuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171911 - RNA, 1413 nt, Artificial Sequence
  derived and/or modified sequence opt4 from neuraminidase__InfluenzaA__ADL60255
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaacuacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcagaggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171912 - RNA, 1413 nt, Artificial Sequence
  derived and/or modified sequence opt4 from neuraminidase__InfluenzaA__ADL60277
augaaccccaaccagagaaucaucaccaucggcagcaucagcaucgccaucggcaucaucagccugaugcugcagaucggcaacaucaucagcaucugggccagccacagcauccagaucggcagccagaacaacaccggcaucugcaaccagagaaucaucaccuacgagaacagcaccugggugaaccacaccuacgugaacaucaacaacaccaacgugguggccggcgaggacaagacccccgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171913 - RNA, 1413 nt, Artificial Sequence
  derived and/or modified sequence opt4 from neuraminidase__InfluenzaA__ADL60288
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171914 - RNA, 1413 nt, Artificial Sequence
  derived and/or modified sequence opt4 from neuraminidase__InfluenzaA__ADL60299
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccaggaccuggacuaccagaucggcuacaucugcagcggcguguucggcgacaaccccagacccaaggacggcaagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171915 - RNA, 1413 nt, Artificial Sequence; identical to SEQ ID NO: 169152
  derived and/or modified sequence opt4 from neuraminidase__InfluenzaA__ADL60310

SEQ ID NO: 171916 - RNA, 1413 nt, Artificial Sequence
  derived and/or modified sequence opt4 from neuraminidase__InfluenzaA__ADL60321
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcauggugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171917 - RNA, 1413 nt, Artificial Sequence
  derived and/or modified sequence opt4 from neuraminidase__InfluenzaA__ADL60332
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcagaggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171918 - RNA, 1413 nt, Artificial Sequence; identical to SEQ ID NO: 169152
  derived and/or modified sequence opt4 from neuraminidase__InfluenzaA__ADL60343

SEQ ID NO: 171919 - RNA, 1413 nt, Artificial Sequence
  derived and/or modified sequence opt4 from neuraminidase__InfluenzaA__ADL60354
augaaccccaaccagagaaucaucaccaucggcagcaucagcaucgccaucggcaucaucagccugaugcugcagaucggcaacaucaucagcaucugggccagccacagcauccagaucggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171920 - RNA, 1410 nt, Artificial Sequence
  derived and/or modified sequence opt4 from neuraminidase__InfluenzaA__ADL60365
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucagccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaucgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaccgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171921 - RNA, 1413 nt, Artificial Sequence
  derived and/or modified sequence opt4 from neuraminidase__InfluenzaA__ADL60376
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccggcaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 171922 - RNA, 1410 nt, Artificial Sequence; identical to SEQ ID NO: 169258
  derived and/or modified sequence opt4 from neuraminidase__InfluenzaA__ADM07137

SEQ ID NO: 171923 - RNA, 1410 nt, Artificial Sequence; identical to SEQ ID NO: 169258
  derived and/or modified sequence opt4 from neuraminidase__InfluenzaA__ADM07146

SEQ ID NO: 171924 - RNA, 1410 nt, Artificial Sequence; identical to SEQ ID NO: 169258
  derived and/or modified sequence opt4 from neuraminidase__InfluenzaA__ADM07156

SEQ ID NO: 171925 - RNA, 1410 nt, Artificial Sequence; identical to SEQ ID NO: 169258
  derived and/or modified sequence opt4 from neuraminidase__InfluenzaA__ADM07165

SEQ ID NO: 171926 - RNA, 1413 nt, Artificial Sequence; identical to SEQ ID NO: 169981
  derived and/or modified sequence opt4 from neuraminidase__InfluenzaA__ADM07474

SEQ ID NO: 171927 - RNA, 1413 nt, Artificial Sequence; identical to SEQ ID NO: 169981
  derived and/or modified sequence opt4 from neuraminidase__InfluenzaA__ADM07485

SEQ ID NO: 171928 - RNA, 1410 nt, Artificial Sequence
  derived and/or modified sequence opt4 from neuraminidase__InfluenzaA__ADM07496
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaacaucaugcccaucuga

SEQ ID NO: 171929 - RNA, 1410 nt, Artificial Sequence
  derived and/or modified sequence opt4 from neuraminidase__InfluenzaA__ADM07507
augaaccccaaccagaagaucaucaccaucggcagcgugagccugaccaucagcaccaucugcuucuucaugcagaccgccauccugaucaccaccgugacccugcacuucaagcaguucgaguucaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 171930 - RNA, 1410 nt, Artificial Sequence
  derived and/or modified sequence opt4 from neuraminidase__InfluenzaA__ADM12820
augaaccccaaccagaagaucaucaccaucggcagcgugagccugaccaucagcaccaucugcuucuucaugcagaucgccauccugaucaccaccgugacccugcacuucaagcaguacaaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 171931 - RNA, 1410 nt, Artificial Sequence; identical to SEQ ID NO: 171930
  derived and/or modified sequence opt4 from neuraminidase__InfluenzaA__ADM12831

SEQ ID NO: 171932 - RNA, 1410 nt, Artificial Sequence; identical to SEQ ID NO: 171930
  derived and/or modified sequence opt4 from neuraminidase__InfluenzaA__ADM12842

SEQ ID NO: 171933 - RNA, 1410 nt, Artificial Sequence; identical to SEQ ID NO: 171930
  derived and/or modified sequence opt4 from neuraminidase__InfluenzaA__ADM12853

SEQ ID NO: 171934 - RNA, 1410 nt, Artificial Sequence; identical to SEQ ID NO: 169258
  derived and/or modified sequence opt4 from neuraminidase__InfluenzaA__ADM12864

SEQ ID NO: 171935 - RNA, 1410 nt, Artificial Sequence; identical to SEQ ID NO: 169258
  derived and/or modified sequence opt4 from neuraminidase__InfluenzaA__ADM12874

SEQ ID NO: 171936 - RNA, 1410 nt, Artificial Sequence; identical to SEQ ID NO: 169258
  derived and/or modified sequence opt4 from neuraminidase__InfluenzaA__ADM12884

SEQ ID NO: 171937 - RNA, 1410 nt, Artificial Sequence
  derived and/or modified sequence opt4 from neuraminidase__InfluenzaA__ADM12894
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccagagcagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171938 - RNA, 1410 nt, Artificial Sequence; identical to SEQ ID NO: 169258
  derived and/or modified sequence opt4 from neuraminidase__InfluenzaA__ADM12904

SEQ ID NO: 171939 - RNA, 1410 nt, Artificial Sequence
  derived and/or modified sequence opt4 from neuraminidase__InfluenzaA__ADM12914
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcuacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171940 - RNA, 1410 nt, Artificial Sequence; identical to SEQ ID NO: 169258
  derived and/or modified sequence opt4 from neuraminidase__InfluenzaA__ADM12924

SEQ ID NO: 171941 - RNA, 1410 nt, Artificial Sequence; identical to SEQ ID NO: 169258
  derived and/or modified sequence opt4 from neuraminidase__InfluenzaA__ADM12934

SEQ ID NO: 171942 - RNA, 1410 nt, Artificial Sequence; identical to SEQ ID NO: 169258
  derived and/or modified sequence opt4 from neuraminidase__InfluenzaA__ADM12944

SEQ ID NO: 171943 - RNA, 1410 nt, Artificial Sequence; identical to SEQ ID NO: 169258
  derived and/or modified sequence opt4 from neuraminidase__InfluenzaA__ADM12954

SEQ ID NO: 171944 - RNA, 1410 nt, Artificial Sequence; identical to SEQ ID NO: 169258
  derived and/or modified sequence opt4 from neuraminidase__InfluenzaA__ADM12964

SEQ ID NO: 171945 - RNA, 1410 nt, Artificial Sequence; identical to SEQ ID NO: 170546
  derived and/or modified sequence opt4 from neuraminidase__InfluenzaA__ADM12974

SEQ ID NO: 171946 - RNA, 1410 nt, Artificial Sequence
  derived and/or modified sequence opt4 from neuraminidase__InfluenzaA__ADM12984
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucagaagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171947 - RNA, 1410 nt, Artificial Sequence; identical to SEQ ID NO: 169258
  derived and/or modified sequence opt4 from neuraminidase__InfluenzaA__ADM12994

SEQ ID NO: 171948 - RNA, 1410 nt, Artificial Sequence; identical to SEQ ID NO: 169258
  derived and/or modified sequence opt4 from neuraminidase__InfluenzaA__ADM13004

SEQ ID NO: 171949 - RNA, 1410 nt, Artificial Sequence; identical to SEQ ID NO: 169258
  derived and/or modified sequence opt4 from neuraminidase__InfluenzaA__ADM13014

SEQ ID NO: 171950 - RNA, 1410 nt, Artificial Sequence
  derived and/or modified sequence opt4 from neuraminidase__InfluenzaA__ADM13034
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcaacugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171951 - RNA, 1410 nt, Artificial Sequence; identical to SEQ ID NO: 171171
  derived and/or modified sequence opt4 from neuraminidase__InfluenzaA__ADM13044

SEQ ID NO: 171952 - RNA, 1410 nt, Artificial Sequence; identical to SEQ ID NO: 170084
  derived and/or modified sequence opt4 from neuraminidase__InfluenzaA__ADM13054

SEQ ID NO: 171953 - RNA, 1410 nt, Artificial Sequence; identical to SEQ ID NO: 170435
  derived and/or modified sequence opt4 from neuraminidase__InfluenzaA__ADM13064

SEQ ID NO: 171954 - RNA, 1410 nt, Artificial Sequence
  derived and/or modified sequence opt4 from neuraminidase__InfluenzaA__ADM13074
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaaccuggccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171955 - RNA, 1410 nt, Artificial Sequence; identical to SEQ ID NO: 170435
  derived and/or modified sequence opt4 from neuraminidase__InfluenzaA__ADM13084

SEQ ID NO: 171956 - RNA, 1410 nt, Artificial Sequence
  derived and/or modified sequence opt4 from neuraminidase__InfluenzaA__ADM13094
augaaccccaaccagaagaucaucaccaucggcagcgugugcaugaccaucggcauggccaaccugauccugcagaucggcaacaccaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgccaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171957 - RNA, 1410 nt, Artificial Sequence; identical to SEQ ID NO: 170435
  derived and/or modified sequence opt4 from neuraminidase__InfluenzaA__ADM13104

SEQ ID NO: 171958 - RNA, 1410 nt, Artificial Sequence; identical to SEQ ID NO: 171160
  derived and/or modified sequence opt4 from neuraminidase__InfluenzaA__ADM13124

SEQ ID NO: 171959 - RNA, 1410 nt, Artificial Sequence
  derived and/or modified sequence opt4 from neuraminidase__InfluenzaA__ADM13134
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacacccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171960 - RNA, 1410 nt, Artificial Sequence
  derived and/or modified sequence opt4 from neuraminidase__InfluenzaA__ADM13154
augaaccccaaccagaagaucaucaccaucggcagcgugugcaugaccaucggcauggccaaccugauccugcagaucggcaacaucaucagcaucuggaucagccacagcauccagcugggcaaccagaagcagaucgagaccugcaaccagagcguguucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171961 - RNA, 1410 nt, Artificial Sequence; identical to SEQ ID NO: 170688
  derived and/or modified sequence opt4 from neuraminidase__InfluenzaA__ADM13164

SEQ ID NO: 171962 - RNA, 1410 nt, Artificial Sequence; identical to SEQ ID NO: 169258
  derived and/or modified sequence opt4 from neuraminidase__InfluenzaA__ADM13174

SEQ ID NO: 171963 - RNA, 1410 nt, Artificial Sequence; identical to SEQ ID NO: 169258
  derived and/or modified sequence opt4 from neuraminidase__InfluenzaA__ADM13184

SEQ ID NO: 171964 - RNA, 1410 nt, Artificial Sequence; identical to SEQ ID NO: 169258
  derived and/or modified sequence opt4 from neuraminidase__InfluenzaA__ADM13194

SEQ ID NO: 171965 - RNA, 1410 nt, Artificial Sequence; identical to SEQ ID NO: 169258
  derived and/or modified sequence opt4 from neuraminidase__InfluenzaA__ADM13204

SEQ ID NO: 171966 - RNA, 1410 nt, Artificial Sequence; identical to SEQ ID NO: 170435
  derived and/or modified sequence opt4 from neuraminidase__InfluenzaA__ADM13214

SEQ ID NO: 171967 - RNA, 1410 nt, Artificial Sequence
  derived and/or modified sequence opt4 from neuraminidase__InfluenzaA__ADM13224
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucagaagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcaagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171968 - RNA, 1410 nt, Artificial Sequence; identical to SEQ ID NO: 169258
  derived and/or modified sequence opt4 from neuraminidase__InfluenzaA__ADM13234

SEQ ID NO: 171969 - RNA, 1410 nt, Artificial Sequence; identical to SEQ ID NO: 170546
  derived and/or modified sequence opt4 from neuraminidase__InfluenzaA__ADM13244

SEQ ID NO: 171970 - RNA, 1410 nt, Artificial Sequence; identical to SEQ ID NO: 169612
  derived and/or modified sequence opt4 from neuraminidase__InfluenzaA__ADM13254

SEQ ID NO: 171971 - RNA, 1410 nt, Artificial Sequence; identical to SEQ ID NO: 170435
  derived and/or modified sequence opt4 from neuraminidase__InfluenzaA__ADM13264

SEQ ID NO: 171972 - RNA, 1410 nt, Artificial Sequence; identical to SEQ ID NO: 169258
  derived and/or modified sequence opt4 from neuraminidase__InfluenzaA__ADM13274

SEQ ID NO: 171973 - RNA, 1410 nt, Artificial Sequence; identical to SEQ ID NO: 169258
  derived and/or modified sequence opt4 from neuraminidase__InfluenzaA__ADM13284

SEQ ID NO: 171974 - RNA, 1410 nt, Artificial Sequence
  derived and/or modified sequence opt4 from neuraminidase__InfluenzaA__ADM13294
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagagcccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171975 - RNA, 1410 nt, Artificial Sequence; identical to SEQ ID NO: 169258
  derived and/or modified sequence opt4 from neuraminidase__InfluenzaA__ADM13304

SEQ ID NO: 171976 - RNA, 1410 nt, Artificial Sequence; identical to SEQ ID NO: 170720
  derived and/or modified sequence opt4 from neuraminidase__InfluenzaA__ADM13314

SEQ ID NO: 171977 - RNA, 1410 nt, Artificial Sequence; identical to SEQ ID NO: 169258
  derived and/or modified sequence opt4 from neuraminidase__InfluenzaA__ADM13324

SEQ ID NO: 171978 - RNA, 1410 nt, Artificial Sequence
  derived and/or modified sequence opt4 from neuraminidase__InfluenzaA__ADM13344
augaaccccaaccagaagaucaucaucaucggcagcgugugcaugaccaucggcauggccaaccugauccugcagaucggcaacaucaucagcaucuggauccugcacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucgccaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171979 - RNA, 1410 nt, Artificial Sequence; identical to SEQ ID NO: 171160
  derived and/or modified sequence opt4 from neuraminidase__InfluenzaA__ADM13354

SEQ ID NO: 171980 - RNA, 1410 nt, Artificial Sequence; identical to SEQ ID NO: 170435
  derived and/or modified sequence opt4 from neuraminidase__InfluenzaA__ADM13363

SEQ ID NO: 171981 - RNA, 1410 nt, Artificial Sequence
  derived and/or modified sequence opt4 from neuraminidase__InfluenzaA__ADM13464
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcaacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccaacaucaacuucaugcccaucuga

SEQ ID NO: 171982 - RNA, 1410 nt, Artificial Sequence
  derived and/or modified sequence opt4 from neuraminidase__InfluenzaA__ADM13465
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaugagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 171983 - RNA, 1410 nt, Artificial Sequence; identical to SEQ ID NO: 166615
  derived and/or modified sequence opt4 from neuraminidase__InfluenzaA__ADM13466

SEQ ID NO: 171984 - RNA, 1410 nt, Artificial Sequence
  derived and/or modified sequence opt4 from neuraminidase__InfluenzaA__ADM13467
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcagcggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 171985 - RNA, 1410 nt, Artificial Sequence; identical to SEQ ID NO: 166615
  derived and/or modified sequence opt4 from neuraminidase__InfluenzaA__ADM13468

SEQ ID NO: 171986 - RNA, 1410 nt, Artificial Sequence
  derived and/or modified sequence opt4 from neuraminidase__InfluenzaA__ADM13469
augaaccccaaccagaagaucaucaccaucggcagcgugagccugaccaucgccaccgccugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 171987 - RNA, 1410 nt, Artificial Sequence
  derived and/or modified sequence opt4 from neuraminidase__InfluenzaA__ADM13470
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucaucgacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 171988 - RNA, 1410 nt, Artificial Sequence
  derived and/or modified sequence opt4 from neuraminidase__InfluenzaA__ADM13471
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagaaucagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 171989 - RNA, 1410 nt, Artificial Sequence; identical to SEQ ID NO: 169028
  derived and/or modified sequence opt4 from neuraminidase__InfluenzaA__ADM13472

SEQ ID NO: 171990 - RNA, 1410 nt, Artificial Sequence; identical to SEQ ID NO: 166615
  derived and/or modified sequence opt4 from neuraminidase__InfluenzaA__ADM13473

SEQ ID NO: 171991 - RNA, 1410 nt, Artificial Sequence; identical to SEQ ID NO: 169023
  derived and/or modified sequence opt4 from neuraminidase__InfluenzaA__ADM13474

SEQ ID NO: 171992 - RNA, 1410 nt, Artificial Sequence
  derived and/or modified sequence opt4 from neuraminidase__InfluenzaA__ADM14469
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaccggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 171993 - RNA, 1410 nt, Artificial Sequence; identical to SEQ ID NO: 169258
  derived and/or modified sequence opt4 from neuraminidase__InfluenzaA__ADM14479

SEQ ID NO: 171994 - RNA, 1410 nt, Artificial Sequence; identical to SEQ ID NO: 169258
  derived and/or modified sequence opt4 from neuraminidase__InfluenzaA__ADM14499

SEQ ID NO: 171995 - RNA, 1410 nt, Artificial Sequence; identical to SEQ ID NO: 170771
  derived and/or modified sequence opt4 from neuraminidase__InfluenzaA__ADM14518

SEQ ID NO: 171996 - RNA, 1410 nt, Artificial Sequence; identical to SEQ ID NO: 171596
  derived and/or modified sequence opt4 from neuraminidase__InfluenzaA__ADM14527

SEQ ID NO: 171997 - RNA, 1410 nt, Artificial Sequence; identical to SEQ ID NO: 170689
  derived and/or modified sequence opt4 from neuraminidase__InfluenzaA__ADM14537

SEQ ID NO: 171998 - RNA, 1410 nt, Artificial Sequence; identical to SEQ ID NO: 169258
  derived and/or modified sequence opt4 from neuraminidase__InfluenzaA__ADM14546

SEQ ID NO: 171999 - RNA, 1410 nt, Artificial Sequence
  derived and/or modified sequence opt4 from neuraminidase__InfluenzaA__ADM14555
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucagauacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172000 - RNA, 1410 nt, Artificial Sequence; identical to SEQ ID NO: 169258
  derived and/or modified sequence opt4 from neuraminidase__InfluenzaA__ADM14573

SEQ ID NO: 172001 - RNA, 1410 nt, Artificial Sequence; identical to SEQ ID NO: 169258
  derived and/or modified sequence opt4 from neuraminidase__InfluenzaA__ADM14582

SEQ ID NO: 172002 - RNA, 1410 nt, Artificial Sequence; identical to SEQ ID NO: 169258
  derived and/or modified sequence opt4 from neuraminidase__InfluenzaA__ADM14591

SEQ ID NO: 172003 - RNA, 1410 nt, Artificial Sequence
  derived and/or modified sequence opt4 from neuraminidase__InfluenzaA__ADM14601
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugaacggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172004 - RNA, 1410 nt, Artificial Sequence
  derived and/or modified sequence opt4 from neuraminidase__InfluenzaA__ADM14611
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcugagcggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172005 - RNA, 1410 nt, Artificial Sequence; identical to SEQ ID NO: 169258
  derived and/or modified sequence opt4 from neuraminidase__InfluenzaA__ADM14620

SEQ ID NO: 172006 - RNA, 1410 nt, Artificial Sequence; identical to SEQ ID NO: 169258
  derived and/or modified sequence opt4 from neuraminidase__InfluenzaA__ADM14629

SEQ ID NO: 172007 - RNA, 1410 nt, Artificial Sequence; identical to SEQ ID NO: 169258
  derived and/or modified sequence opt4 from neuraminidase__InfluenzaA__ADM14639

SEQ ID NO: 172008 - RNA, 1410 nt, Artificial Sequence; identical to SEQ ID NO: 169258
  derived and/or modified sequence opt4 from neuraminidase__InfluenzaA__ADM14657

SEQ ID NO: 172009 - RNA, 1410 nt, Artificial Sequence; identical to SEQ ID NO: 169258
  derived and/or modified sequence opt4 from neuraminidase__InfluenzaA__ADM14666

SEQ ID NO: 172010 - RNA, 1410 nt, Artificial Sequence; identical to SEQ ID NO: 169258
  derived and/or modified sequence opt4 from neuraminidase__InfluenzaA__ADM14684

SEQ ID NO: 172011 - RNA, 1410 nt, Artificial Sequence
  derived and/or modified sequence opt4 from neuraminidase__InfluenzaA__ADM14693
augaaccccaaccagaagaugaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172012 - RNA, 1410 nt, Artificial Sequence
  derived and/or modified sequence opt4 from neuraminidase__InfluenzaA__ADM14702
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcgccuggaucggcagaaccaagagcaccagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172013 - RNA, 1410 nt, Artificial Sequence; identical to SEQ ID NO: 171160
  derived and/or modified sequence opt4 from neuraminidase__InfluenzaA__ADM14711

SEQ ID NO: 172014 - RNA, 1410 nt, Artificial Sequence
  derived and/or modified sequence opt4 from neuraminidase__InfluenzaA__ADM14720
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172015 - RNA, 1410 nt, Artificial Sequence
  derived and/or modified sequence opt4 from neuraminidase__InfluenzaA__ADM14730
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccguguacagcaaggacaacagcaucagaaucggcagcaagggcgacgugcuggugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaagcggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172016 - RNA, 1350 nt, Artificial Sequence
  derived and/or modified sequence opt4 from neuraminidase__InfluenzaA__ADM14748
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172017 - RNA, 1410 nt, Artificial Sequence
  derived and/or modified sequence opt4 from neuraminidase__InfluenzaA__ADM14758
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaucaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172018 - RNA, 1410 nt, Artificial Sequence; identical to SEQ ID NO: 172017
  derived and/or modified sequence opt4 from neuraminidase__InfluenzaA__ADM14767

SEQ ID NO: 172019 - RNA, 1410 nt, Artificial Sequence; identical to SEQ ID NO: 169258
  derived and/or modified sequence opt4 from neuraminidase__InfluenzaA__ADM14777

SEQ ID NO: 172020 - RNA, 1410 nt, Artificial Sequence; identical to SEQ ID NO: 169258
  derived and/or modified sequence opt4 from neuraminidase__InfluenzaA__ADM14814

SEQ ID NO: 172021 - RNA, 1410 nt, Artificial Sequence; identical to SEQ ID NO: 169258
  derived and/or modified sequence opt4 from neuraminidase__InfluenzaA__ADM14823

SEQ ID NO: 172022 - RNA, 1410 nt, Artificial Sequence; identical to SEQ ID NO: 170881
  derived and/or modified sequence opt4 from neuraminidase__InfluenzaA__ADM14841

SEQ ID NO: 172023 - RNA, 1410 nt, Artificial Sequence; identical to SEQ ID NO: 170881
  derived and/or modified sequence opt4 from neuraminidase__InfluenzaA__ADM14859

SEQ ID NO: 172024 - RNA, 1410 nt, Artificial Sequence; identical to SEQ ID NO: 170395
  derived and/or modified sequence opt4 from neuraminidase__InfluenzaA__ADM14868

SEQ ID NO: 172025 - RNA, 1410 nt, Artificial Sequence; identical to SEQ ID NO: 170881
  derived and/or modified sequence opt4 from neuraminidase__InfluenzaA__ADM14878

SEQ ID NO: 172026 - RNA, 1410 nt, Artificial Sequence; identical to SEQ ID NO: 169258
  derived and/or modified sequence opt4 from neuraminidase__InfluenzaA__ADM14887

SEQ ID NO: 172027 - RNA, 1410 nt, Artificial Sequence
  derived and/or modified sequence opt4 from neuraminidase__InfluenzaA__ADM14896
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacgugcuggugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172028 - RNA, 1410 nt, Artificial Sequence; identical to SEQ ID NO: 169258
  derived and/or modified sequence opt4 from neuraminidase__InfluenzaA__ADM14905

SEQ ID NO: 172029 - RNA, 1410 nt, Artificial Sequence; identical to SEQ ID NO: 169258
  derived and/or modified sequence opt4 from neuraminidase__InfluenzaA__ADM14923

SEQ ID NO: 172030 - RNA, 1410 nt, Artificial Sequence; identical to SEQ ID NO: 170546
  derived and/or modified sequence opt4 from neuraminidase__InfluenzaA__ADM14932

SEQ ID NO: 172031 - RNA, 1410 nt, Artificial Sequence; identical to SEQ ID NO: 169258
  derived and/or modified sequence opt4 from neuraminidase__InfluenzaA__ADM14950

SEQ ID NO: 172032 - RNA, 1410 nt, Artificial Sequence; identical to SEQ ID NO: 170276
  derived and/or modified sequence opt4 from neuraminidase__InfluenzaA__ADM14959

SEQ ID NO: 172033 - RNA, 1410 nt, Artificial Sequence
  derived and/or modified sequence opt4 from neuraminidase__InfluenzaA__ADM14977
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugaacggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172034 - RNA, 1410 nt, Artificial Sequence; identical to SEQ ID NO: 170881
  derived and/or modified sequence opt4 from neuraminidase__InfluenzaA__ADM14987

SEQ ID NO: 172035 - RNA, 1410 nt, Artificial Sequence; identical to SEQ ID NO: 170425
  derived and/or modified sequence opt4 from neuraminidase__InfluenzaA__ADM26787

SEQ ID NO: 172036 - RNA, 1410 nt, Artificial Sequence; identical to SEQ ID NO: 171004
  derived and/or modified sequence opt4 from neuraminidase__InfluenzaA__ADM26798

SEQ ID NO: 172037 - RNA, 1410 nt, Artificial Sequence
  derived and/or modified sequence opt4 from neuraminidase__InfluenzaA__ADM26809
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccaccgugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 172038 - RNA, 1410 nt, Artificial Sequence
  derived and/or modified sequence opt4 from neuraminidase__InfluenzaA__ADM26820
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 172039 - RNA, 1350 nt, Artificial Sequence
  derived and/or modified sequence opt4 from neuraminidase__InfluenzaA__ADM31427
augaaccccaaccagaagaucaucaccaucggcagcgugugcaugaucaucggcaucgugagccugaugcugcagaucggcaacaugaucagcaucugggugagccacagcauccagaccggcaaccagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccacauggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggggcaacaacauccugagaacccaggagagcgagugcgccugcgugaacggcagcugcuucaccgugaugaccgacggccccagcaacggccaggccagcuacaagaucuucaagaucgagaagggcaagguggugaagagcguggagcugaacgcccccaacuaccacuacgaggagugcagcugcuaccccgacagcggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgaguucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 172040 - RNA, 1410 nt, Artificial Sequence
  derived and/or modified sequence opt4 from neuraminidase__InfluenzaA__ADM31481
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaagggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172041 - RNA, 1410 nt, Artificial Sequence; identical to SEQ ID NO: 169841
  derived and/or modified sequence opt4 from neuraminidase__InfluenzaA__ADM31491

SEQ ID NO: 172042 - RNA, 1410 nt, Artificial Sequence; identical to SEQ ID NO: 171463
  derived and/or modified sequence opt4 from neuraminidase__InfluenzaA__ADM31501

SEQ ID NO: 172043 - RNA, 1410 nt, Artificial Sequence; identical to SEQ ID NO: 169258
  derived and/or modified sequence opt4 from neuraminidase__InfluenzaA__ADM31511

SEQ ID NO: 172044 - RNA, 1410 nt, Artificial Sequence; identical to SEQ ID NO: 171459
  derived and/or modified sequence opt4 from neuraminidase__InfluenzaA__ADM31521

SEQ ID NO: 172045 - RNA, 1410 nt, Artificial Sequence; identical to SEQ ID NO: 169258
  derived and/or modified sequence opt4 from neuraminidase__InfluenzaA__ADM31531

SEQ ID NO: 172046 - RNA, 1410 nt, Artificial Sequence; identical to SEQ ID NO: 170546
  derived and/or modified sequence opt4 from neuraminidase__InfluenzaA__ADM31541

SEQ ID NO: 172047 - RNA, 1410 nt, Artificial Sequence; identical to SEQ ID NO: 169258
  derived and/or modified sequence opt4 from neuraminidase__InfluenzaA__ADM31551

SEQ ID NO: 172048 - RNA, 1410 nt, Artificial Sequence; identical to SEQ ID NO: 169258
  derived and/or modified sequence opt4 from neuraminidase__InfluenzaA__ADM31561

SEQ ID NO: 172049 - RNA, 1410 nt, Artificial Sequence; identical to SEQ ID NO: 169258
  derived and/or modified sequence opt4 from neuraminidase__InfluenzaA__ADM31571

SEQ ID NO: 172050 - RNA, 1410 nt, Artificial Sequence; identical to SEQ ID NO: 170435
  derived and/or modified sequence opt4 from neuraminidase__InfluenzaA__ADM31581

SEQ ID NO: 172051 - RNA, 1410 nt, Artificial Sequence; identical to SEQ ID NO: 169258
  derived and/or modified sequence opt4 from neuraminidase__InfluenzaA__ADM31601

SEQ ID NO: 172052 - RNA, 1410 nt, Artificial Sequence; identical to SEQ ID NO: 170546
  derived and/or modified sequence opt4 from neuraminidase__InfluenzaA__ADM31611

SEQ ID NO: 172053 - RNA, 1410 nt, Artificial Sequence
  derived and/or modified sequence opt4 from neuraminidase__InfluenzaA__ADM31621
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcagccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172054 - RNA, 1410 nt, Artificial Sequence; identical to SEQ ID NO: 170546
  derived and/or modified sequence opt4 from neuraminidase__InfluenzaA__ADM31631

SEQ ID NO: 172055 - RNA, 1410 nt, Artificial Sequence; identical to SEQ ID NO: 170435
  derived and/or modified sequence opt4 from neuraminidase__InfluenzaA__ADM31641

SEQ ID NO: 172056 - RNA, 1410 nt, Artificial Sequence; identical to SEQ ID NO: 170720
  derived and/or modified sequence opt4 from neuraminidase__InfluenzaA__ADM31651

SEQ ID NO: 172057 - RNA, 1410 nt, Artificial Sequence; identical to SEQ ID NO: 170435
  derived and/or modified sequence opt4 from neuraminidase__InfluenzaA__ADM31661

SEQ ID NO: 172058 - RNA, 1410 nt, Artificial Sequence
  derived and/or modified sequence opt4 from neuraminidase__InfluenzaA__ADM31671
augaaccccaaccagaagaucaucaccaucggcagcgugugcaugaccaucggcauggccaaccugauccugcagaucggcaacaucaucagcaucuggaucagccacagcacccagcugggcaaccagaaccagaucgagaccugcaaccagagcgugaucaccuacgagaacaacaccugggugaaccagaccuacgugaacaucagcaacaccaacuucgccgccggccagagcguggugagcgccaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172059 - RNA, 1410 nt, Artificial Sequence; identical to SEQ ID NO: 170546
  derived and/or modified sequence opt4 from neuraminidase__InfluenzaA__ADM31681

SEQ ID NO: 172060 - RNA, 1410 nt, Artificial Sequence
  derived and/or modified sequence opt4 from neuraminidase__InfluenzaA__ADM31691
augaaccccaaccagaagauccugaccaucggcagcgugugcaugaccaucggcauggccaaccugauccugcagaucggcaacaucaucagcaucuggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172061 - RNA, 1410 nt, Artificial Sequence; identical to SEQ ID NO: 169258
  derived and/or modified sequence opt4 from neuraminidase__InfluenzaA__ADM31701

SEQ ID NO: 172062 - RNA, 1410 nt, Artificial Sequence; identical to SEQ ID NO: 169258
  derived and/or modified sequence opt4 from neuraminidase__InfluenzaA__ADM31711

SEQ ID NO: 172063 - RNA, 1410 nt, Artificial Sequence; identical to SEQ ID NO: 170546
  derived and/or modified sequence opt4 from neuraminidase__InfluenzaA__ADM31721

SEQ ID NO: 172064 - RNA, 1410 nt, Artificial Sequence
  derived and/or modified sequence opt4 from neuraminidase__InfluenzaA__ADM31731
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcagaaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172065 - RNA, 1410 nt, Artificial Sequence; identical to SEQ ID NO: 171633
  derived and/or modified sequence opt4 from neuraminidase__InfluenzaA__ADM31741

SEQ ID NO: 172066 - RNA, 1410 nt, Artificial Sequence; identical to SEQ ID NO: 169258
  derived and/or modified sequence opt4 from neuraminidase__InfluenzaA__ADM31751

SEQ ID NO: 172067 - RNA, 1410 nt, Artificial Sequence
  derived and/or modified sequence opt4 from neuraminidase__InfluenzaA__ADM31761
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccacaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucagcgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172068 - RNA, 1410 nt, Artificial Sequence
  derived and/or modified sequence opt4 from neuraminidase__InfluenzaA__ADM31771
augaaccccaaccagaagauccugaccaucggcagcgugugcaugaccaucggcauggccaaccugauccugcagaucggcaacaucaucagcaucuggaucagccacagcauccagcugggcaaccagaaccagaccgagaccugcaaccagagcgugaucaucuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172069 - RNA, 1410 nt, Artificial Sequence
  derived and/or modified sequence opt4 from neuraminidase__InfluenzaA__ADM31801
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucaacaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172070 - RNA, 1410 nt, Artificial Sequence
  derived and/or modified sequence opt4 from neuraminidase__InfluenzaA__ADM31811
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaaguucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172071 - RNA, 1410 nt, Artificial Sequence; identical to SEQ ID NO: 170435
  derived and/or modified sequence opt4 from neuraminidase__InfluenzaA__ADM31821

SEQ ID NO: 172072 - RNA, 1410 nt, Artificial Sequence; identical to SEQ ID NO: 169258
  derived and/or modified sequence opt4 from neuraminidase__InfluenzaA__ADM31831

SEQ ID NO: 172073 - RNA, 1410 nt, Artificial Sequence; identical to SEQ ID NO: 169258
  derived and/or modified sequence opt4 from neuraminidase__InfluenzaA__ADM31841

SEQ ID NO: 172074 - RNA, 1410 nt, Artificial Sequence
  derived and/or modified sequence opt4 from neuraminidase__InfluenzaA__ADM31851
augaaccccaaccagaagauccugaccaucggcagcgugugcaugaccaucggcauggccaaccugauccugcagaucggcaacaucaucagcaucuggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagagaggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172075 - RNA, 1410 nt, Artificial Sequence; identical to SEQ ID NO: 169258
  derived and/or modified sequence opt4 from neuraminidase__InfluenzaA__ADM31861

SEQ ID NO: 172076 - RNA, 1410 nt, Artificial Sequence; identical to SEQ ID NO: 169258
  derived and/or modified sequence opt4 from neuraminidase__InfluenzaA__ADM31871

SEQ ID NO: 172077 - RNA, 1410 nt, Artificial Sequence
  derived and/or modified sequence opt4 from neuraminidase__InfluenzaA__ADM31881
augaaccccaaccagaagaucaucaccaucggcagcgugugcaugaccaucggcauggccaaccugauccugcagaucggcaacaccaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172078 - RNA, 1410 nt, Artificial Sequence; identical to SEQ ID NO: 169258
  derived and/or modified sequence opt4 from neuraminidase__InfluenzaA__ADM31891

SEQ ID NO: 172079 - RNA, 1410 nt, Artificial Sequence; identical to SEQ ID NO: 169248
  derived and/or modified sequence opt4 from neuraminidase__InfluenzaA__ADM31901

SEQ ID NO: 172080 - RNA, 1410 nt, Artificial Sequence; identical to SEQ ID NO: 170481
  derived and/or modified sequence opt4 from neuraminidase__InfluenzaA__ADM31911

SEQ ID NO: 172081 - RNA, 1410 nt, Artificial Sequence; identical to SEQ ID NO: 170481
  derived and/or modified sequence opt4 from neuraminidase__InfluenzaA__ADM31921

SEQ ID NO: 172082 - RNA, 1410 nt, Artificial Sequence; identical to SEQ ID NO: 170939
  derived and/or modified sequence opt4 from neuraminidase__InfluenzaA__ADM31931

SEQ ID NO: 172083 - RNA, 1410 nt, Artificial Sequence; identical to SEQ ID NO: 169248
  derived and/or modified sequence opt4 from neuraminidase__InfluenzaA__ADM31941

SEQ ID NO: 172084 - RNA, 1410 nt, Artificial Sequence; identical to SEQ ID NO: 170939
  derived and/or modified sequence opt4 from neuraminidase__InfluenzaA__ADM31951

SEQ ID NO: 172085 - RNA, 1410 nt, Artificial Sequence
  derived and/or modified sequence opt4 from neuraminidase__InfluenzaA__ADM31961
augaaccccaaccagaagaucaucaccaucggcagcgugugcauggccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172086 - RNA, 1410 nt, Artificial Sequence
  derived and/or modified sequence opt4 from neuraminidase__InfluenzaA__ADM31971
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcaugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcgugaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172087 - RNA, 1410 nt, Artificial Sequence; identical to SEQ ID NO: 170481
  derived and/or modified sequence opt4 from neuraminidase__InfluenzaA__ADM31981

SEQ ID NO: 172088 - RNA, 1410 nt, Artificial Sequence; identical to SEQ ID NO: 169248
  derived and/or modified sequence opt4 from neuraminidase__InfluenzaA__ADM31991

SEQ ID NO: 172089 - RNA, 1410 nt, Artificial Sequence; identical to SEQ ID NO: 169248
  derived and/or modified sequence opt4 from neuraminidase__InfluenzaA__ADM32001

SEQ ID NO: 172090 - RNA, 1410 nt, Artificial Sequence; identical to SEQ ID NO: 169248
  derived and/or modified sequence opt4 from neuraminidase__InfluenzaA__ADM32011

SEQ ID NO: 172091 - RNA, 1410 nt, Artificial Sequence; identical to SEQ ID NO: 169258
  derived and/or modified sequence opt4 from neuraminidase__InfluenzaA__ADM32021

SEQ ID NO: 172092 - RNA, 1410 nt, Artificial Sequence; identical to SEQ ID NO: 170228
  derived and/or modified sequence opt4 from neuraminidase__InfluenzaA__ADM32031

SEQ ID NO: 172093 - RNA, 1410 nt, Artificial Sequence; identical to SEQ ID NO: 170982
  derived and/or modified sequence opt4 from neuraminidase__InfluenzaA__ADM32051

SEQ ID NO: 172094 - RNA, 1410 nt, Artificial Sequence; identical to SEQ ID NO: 169258
  derived and/or modified sequence opt4 from neuraminidase__InfluenzaA__ADM32061

SEQ ID NO: 172095 - RNA, 1410 nt, Artificial Sequence; identical to SEQ ID NO: 169258
  derived and/or modified sequence opt4 from neuraminidase__InfluenzaA__ADM32071

SEQ ID NO: 172096 - RNA, 1410 nt, Artificial Sequence; identical to SEQ ID NO: 169258
  derived and/or modified sequence opt4 from neuraminidase__InfluenzaA__ADM32081

SEQ ID NO: 172097 - RNA, 1410 nt, Artificial Sequence; identical to SEQ ID NO: 170481
  derived and/or modified sequence opt4 from neuraminidase__InfluenzaA__ADM32091

SEQ ID NO: 172098 - RNA, 1410 nt, Artificial Sequence; identical to SEQ ID NO: 169258
  derived and/or modified sequence opt4 from neuraminidase__InfluenzaA__ADM32101

SEQ ID NO: 172099 - RNA, 1410 nt, Artificial Sequence; identical to SEQ ID NO: 169258
  derived and/or modified sequence opt4 from neuraminidase__InfluenzaA__ADM32111

SEQ ID NO: 172100 - RNA, 1410 nt, Artificial Sequence; identical to SEQ ID NO: 170939
  derived and/or modified sequence opt4 from neuraminidase__InfluenzaA__ADM32554

SEQ ID NO: 172101 - RNA, 1410 nt, Artificial Sequence; identical to SEQ ID NO: 169248
  derived and/or modified sequence opt4 from neuraminidase__InfluenzaA__ADM32564

SEQ ID NO: 172102 - RNA, 1410 nt, Artificial Sequence; identical to SEQ ID NO: 170481
  derived and/or modified sequence opt4 from neuraminidase__InfluenzaA__ADM32574

SEQ ID NO: 172103 - RNA, 1410 nt, Artificial Sequence; identical to SEQ ID NO: 169258
  derived and/or modified sequence opt4 from neuraminidase__InfluenzaA__ADM32584

SEQ ID NO: 172104 - RNA, 1410 nt, Artificial Sequence; identical to SEQ ID NO: 170939
  derived and/or modified sequence opt4 from neuraminidase__InfluenzaA__ADM32594

SEQ ID NO: 172105 - RNA, 1410 nt, Artificial Sequence; identical to SEQ ID NO: 169258
  derived and/or modified sequence opt4 from neuraminidase__InfluenzaA__ADM32604

SEQ ID NO: 172106 - RNA, 1410 nt, Artificial Sequence; identical to SEQ ID NO: 169258
  derived and/or modified sequence opt4 from neuraminidase__InfluenzaA__ADM32614

SEQ ID NO: 172107 - RNA, 1410 nt, Artificial Sequence; identical to SEQ ID NO: 169258
  derived and/or modified sequence opt4 from neuraminidase__InfluenzaA__ADM32624

SEQ ID NO: 172108 - RNA, 1410 nt, Artificial Sequence; identical to SEQ ID NO: 170939
  derived and/or modified sequence opt4 from neuraminidase__InfluenzaA__ADM32634

SEQ ID NO: 172109 - RNA, 1410 nt, Artificial Sequence; identical to SEQ ID NO: 169258
  derived and/or modified sequence opt4 from neuraminidase__InfluenzaA__ADM32644

SEQ ID NO: 172110 - RNA, 1410 nt, Artificial Sequence; identical to SEQ ID NO: 169258
  derived and/or modified sequence opt4 from neuraminidase__InfluenzaA__ADM32664

SEQ ID NO: 172111 - RNA, 1410 nt, Artificial Sequence; identical to SEQ ID NO: 170481
  derived and/or modified sequence opt4 from neuraminidase__InfluenzaA__ADM32674

SEQ ID NO: 172112 - RNA, 1410 nt, Artificial Sequence; identical to SEQ ID NO: 169258
  derived and/or modified sequence opt4 from neuraminidase__InfluenzaA__ADM32684

SEQ ID NO: 172113 - RNA, 1410 nt, Artificial Sequence; identical to SEQ ID NO: 169248
  derived and/or modified sequence opt4 from neuraminidase__InfluenzaA__ADM32694

SEQ ID NO: 172114 - RNA, 1410 nt, Artificial Sequence; identical to SEQ ID NO: 169258
  derived and/or modified sequence opt4 from neuraminidase__InfluenzaA__ADM32704

SEQ ID NO: 172115 - RNA, 1410 nt, Artificial Sequence; identical to SEQ ID NO: 170982
  derived and/or modified sequence opt4 from neuraminidase__InfluenzaA__ADM32714

SEQ ID NO: 172116 - RNA, 1410 nt, Artificial Sequence; identical to SEQ ID NO: 170982
  derived and/or modified sequence opt4 from neuraminidase__InfluenzaA__ADM32724

SEQ ID NO: 172117 - RNA, 1410 nt, Artificial Sequence; identical to SEQ ID NO: 169258
  derived and/or modified sequence opt4 from neuraminidase__InfluenzaA__ADM32734

SEQ ID NO: 172118 - RNA, 1410 nt, Artificial Sequence; identical to SEQ ID NO: 170481
  derived and/or modified sequence opt4 from neuraminidase__InfluenzaA__ADM32744

SEQ ID NO: 172119 - RNA, 1410 nt, Artificial Sequence; identical to SEQ ID NO: 170982
  derived and/or modified sequence opt4 from neuraminidase__InfluenzaA__ADM32754

SEQ ID NO: 172120 - RNA, 1410 nt, Artificial Sequence; identical to SEQ ID NO: 170481
  derived and/or modified sequence opt4 from neuraminidase__InfluenzaA__ADM32764

SEQ ID NO: 172121 - RNA, 1410 nt, Artificial Sequence
  derived and/or modified sequence opt4 from neuraminidase__InfluenzaA__ADM32774
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaccaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172122 - RNA, 1410 nt, Artificial Sequence; identical to SEQ ID NO: 170228
  derived and/or modified sequence opt4 from neuraminidase__InfluenzaA__ADM32784

SEQ ID NO: 172123 - RNA, 1410 nt, Artificial Sequence; identical to SEQ ID NO: 170481
  derived and/or modified sequence opt4 from neuraminidase__InfluenzaA__ADM32794

SEQ ID NO: 172124 - RNA, 1410 nt, Artificial Sequence
  derived and/or modified sequence opt4 from neuraminidase__InfluenzaA__ADM32804
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggugggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucguggagaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172125 - RNA, 1410 nt, Artificial Sequence
  derived and/or modified sequence opt4 from neuraminidase__InfluenzaA__ADM32814
augaaccccaaccagaagaucaucaccaucggcagcgugugcaugaccaucggcauggccaaccugauccugcagaucggcaacaucaucagcaucuggaucagccacagcauccagcugggcaaccagaaccagguggagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172126 - RNA, 1410 nt, Artificial Sequence; identical to SEQ ID NO: 169258
  derived and/or modified sequence opt4 from neuraminidase__InfluenzaA__ADM32824

SEQ ID NO: 172127 - RNA, 1410 nt, Artificial Sequence; identical to SEQ ID NO: 170481
  derived and/or modified sequence opt4 from neuraminidase__InfluenzaA__ADM32834

SEQ ID NO: 172128 - RNA, 1410 nt, Artificial Sequence; identical to SEQ ID NO: 169248
  derived and/or modified sequence opt4 from neuraminidase__InfluenzaA__ADM32844

SEQ ID NO: 172129 - RNA, 1410 nt, Artificial Sequence
  derived and/or modified sequence opt4 from neuraminidase__InfluenzaA__ADM32854
augaaccccaaccagaagaucaucaccaucggcagcgugugcaccaccaucggcauggccaaccugauccugcagaucggcaacaucaucagcaucuggaucagccacagcauccaguucggcaaccagaaccagaucgagaccugcaaccagagcgugaucaccuacgagaacaacaccugggugaaccagaccuacgugaacaucagcaacaccaacuucgccgccggccagagcguggugagcgugaagcuggugggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172130 - RNA, 1410 nt, Artificial Sequence; identical to SEQ ID NO: 169248
  derived and/or modified sequence opt4 from neuraminidase__InfluenzaA__ADM32864

SEQ ID NO: 172131 - RNA, 1410 nt, Artificial Sequence; identical to SEQ ID NO: 169258
  derived and/or modified sequence opt4 from neuraminidase__InfluenzaA__ADM32874

SEQ ID NO: 172132 - RNA, 1410 nt, Artificial Sequence
  derived and/or modified sequence opt4 from neuraminidase__InfluenzaA__ADM32884
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgugggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172133 - RNA, 1410 nt, Artificial Sequence; identical to SEQ ID NO: 169258
  derived and/or modified sequence opt4 from neuraminidase__InfluenzaA__ADM32921

SEQ ID NO: 172134 - RNA, 1410 nt, Artificial Sequence; identical to SEQ ID NO: 169258
  derived and/or modified sequence opt4 from neuraminidase__InfluenzaA__ADM32931

SEQ ID NO: 172135 - RNA, 1410 nt, Artificial Sequence
  derived and/or modified sequence opt4 from neuraminidase__InfluenzaA__ADM32941
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaacagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172136 - RNA, 1410 nt, Artificial Sequence; identical to SEQ ID NO: 169258
  derived and/or modified sequence opt4 from neuraminidase__InfluenzaA__ADM32951

SEQ ID NO: 172137 - RNA, 1410 nt, Artificial Sequence; identical to SEQ ID NO: 169841
  derived and/or modified sequence opt4 from neuraminidase__InfluenzaA__ADM32960

SEQ ID NO: 172138 - RNA, 1410 nt, Artificial Sequence; identical to SEQ ID NO: 169258
  derived and/or modified sequence opt4 from neuraminidase__InfluenzaA__ADM32969

SEQ ID NO: 172139 - RNA, 1410 nt, Artificial Sequence; identical to SEQ ID NO: 169258
  derived and/or modified sequence opt4 from neuraminidase__InfluenzaA__ADM32979

SEQ ID NO: 172140 - RNA, 1410 nt, Artificial Sequence; identical to SEQ ID NO: 171160
  derived and/or modified sequence opt4 from neuraminidase__InfluenzaA__ADM32988

SEQ ID NO: 172141 - RNA, 1410 nt, Artificial Sequence; identical to SEQ ID NO: 171160
  derived and/or modified sequence opt4 from neuraminidase__InfluenzaA__ADM32997

SEQ ID NO: 172142 - RNA, 1410 nt, Artificial Sequence; identical to SEQ ID NO: 169258
  derived and/or modified sequence opt4 from neuraminidase__InfluenzaA__ADM33006

SEQ ID NO: 172143 - RNA, 1410 nt, Artificial Sequence; identical to SEQ ID NO: 171160
  derived and/or modified sequence opt4 from neuraminidase__InfluenzaA__ADM33015

SEQ ID NO: 172144 - RNA, 1410 nt, Artificial Sequence
  derived and/or modified sequence opt4 from neuraminidase__InfluenzaA__ADM33025
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaagcaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172145 - RNA, 1410 nt, Artificial Sequence; identical to SEQ ID NO: 169258
  derived and/or modified sequence opt4 from neuraminidase__InfluenzaA__ADM33042

SEQ ID NO: 172146 - RNA, 1410 nt, Artificial Sequence; identical to SEQ ID NO: 169258
  derived and/or modified sequence opt4 from neuraminidase__InfluenzaA__ADM33062

SEQ ID NO: 172147 - RNA, 1410 nt, Artificial Sequence
  derived and/or modified sequence opt4 from neuraminidase__InfluenzaA__ADM33071
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcaagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacggcgacaccgugggcuggagcuggcccgacggcgccgagcugcccuucaccaucgacaaguga

SEQ ID NO: 172148 - RNA, 1410 nt, Artificial Sequence; identical to SEQ ID NO: 169258
  derived and/or modified sequence opt4 from neuraminidase__InfluenzaA__ADM33081

SEQ ID NO: 172149 - RNA, 1410 nt, Artificial Sequence; identical to SEQ ID NO: 170331
  derived and/or modified sequence opt4 from neuraminidase__InfluenzaA__ADM33091

SEQ ID NO: 172150 - RNA, 1410 nt, Artificial Sequence; identical to SEQ ID NO: 170331
  derived and/or modified sequence opt4 from neuraminidase__InfluenzaA__ADM33101

SEQ ID NO: 172151 - RNA, 1410 nt, Artificial Sequence; identical to SEQ ID NO: 170331
  derived and/or modified sequence opt4 from neuraminidase__InfluenzaA__ADM33111

SEQ ID NO: 172152 - RNA, 1410 nt, Artificial Sequence; identical to SEQ ID NO: 169258
  derived and/or modified sequence opt4 from neuraminidase__InfluenzaA__ADM33121

SEQ ID NO: 172153 - RNA, 1410 nt, Artificial Sequence; identical to SEQ ID NO: 169258
  derived and/or modified sequence opt4 from neuraminidase__InfluenzaA__ADM33130

SEQ ID NO: 172154 - RNA, 1410 nt, Artificial Sequence; identical to SEQ ID NO: 169258
  derived and/or modified sequence opt4 from neuraminidase__InfluenzaA__ADM33139

SEQ ID NO: 172155 - RNA, 1410 nt, Artificial Sequence; identical to SEQ ID NO: 169258
  derived and/or modified sequence opt4 from neuraminidase__InfluenzaA__ADM33149

SEQ ID NO: 172156 - RNA, 1410 nt, Artificial Sequence; identical to SEQ ID NO: 169258
  derived and/or modified sequence opt4 from neuraminidase__InfluenzaA__ADM33159

SEQ ID NO: 172157 - RNA, 1410 nt, Artificial Sequence; identical to SEQ ID NO: 169258
  derived and/or modified sequence opt4 from neuraminidase__InfluenzaA__ADM33169

SEQ ID NO: 172158 - RNA, 1410 nt, Artificial Sequence; identical to SEQ ID NO: 169258
  derived and/or modified sequence opt4 from neuraminidase__InfluenzaA__ADM33179

SEQ ID NO: 172159 - RNA, 1410 nt, Artificial Sequence; identical to SEQ ID NO: 169258
  derived and/or modified sequence opt4 from neuraminidase__InfluenzaA__ADM33188

SEQ ID NO: 172160 - RNA, 1410 nt, Artificial Sequence; identical to SEQ ID NO: 169258
  derived and/or modified sequence opt4 from neuraminidase__InfluenzaA__ADM33197

SEQ ID NO: 172161 - RNA, 1410 nt, Artificial Sequence; identical to SEQ ID NO: 169258
  derived and/or modified sequence opt4 from neuraminidase__InfluenzaA__ADM33206

SEQ ID NO: 172162 - RNA, 1410 nt, Artificial Sequence; identical to SEQ ID NO: 169258
  derived and/or modified sequence opt4 from neuraminidase__InfluenzaA__ADM33215

SEQ ID NO: 172163 - RNA, 1410 nt, Artificial Sequence; identical to SEQ ID NO: 169258
  derived and/or modified sequence opt4 from neuraminidase__InfluenzaA__ADM33224

SEQ ID NO: 172164 - RNA, 1410 nt, Artificial Sequence; identical to SEQ ID NO: 169258
  derived and/or modified sequence opt4 from neuraminidase__InfluenzaA__ADM33234

SEQ ID NO: 172165 - RNA, 1410 nt, Artificial Sequence; identical to SEQ ID NO: 169682
  derived and/or modified sequence opt4 from neuraminidase__InfluenzaA__ADM33243

SEQ ID NO: 172166 - RNA, 1410 nt, Artificial Sequence; identical to SEQ ID NO: 169258
  derived and/or modified sequence opt4 from neuraminidase__InfluenzaA__ADM33253

SEQ ID NO: 172167 - RNA, 1410 nt, Artificial Sequence; identical to SEQ ID NO: 169682
  derived and/or modified sequence opt4 from neuraminidase__InfluenzaA__ADM33262

SEQ ID NO: 172168 - RNA, 1410 nt, Artificial Sequence; identical to SEQ ID NO: 169288
  derived and/or modified sequence opt4 from neuraminidase__InfluenzaA__ADM33272

SEQ ID NO: 172169 - RNA, 1410 nt, Artificial Sequence; identical to SEQ ID NO: 169288
  derived and/or modified sequence opt4 from neuraminidase__InfluenzaA__ADM33282

SEQ ID NO: 172170 - RNA, 1410 nt, Artificial Sequence; identical to SEQ ID NO: 169258
  derived and/or modified sequence opt4 from neuraminidase__InfluenzaA__ADM33292

SEQ ID NO: 172171 - RNA, 1410 nt, Artificial Sequence; identical to SEQ ID NO: 169258
  derived and/or modified sequence opt4 from neuraminidase__InfluenzaA__ADM33302

SEQ ID NO: 172172 - RNA, 1410 nt, Artificial Sequence; identical to SEQ ID NO: 169248
  derived and/or modified sequence opt4 from neuraminidase__InfluenzaA__ADM33312

SEQ ID NO: 172173 - RNA, 1410 nt, Artificial Sequence; identical to SEQ ID NO: 169288
  derived and/or modified sequence opt4 from neuraminidase__InfluenzaA__ADM33322

SEQ ID NO: 172174 - RNA, 1410 nt, Artificial Sequence; identical to SEQ ID NO: 169288
  derived and/or modified sequence opt4 from neuraminidase__InfluenzaA__ADM33332

SEQ ID NO: 172175 - RNA, 1410 nt, Artificial Sequence; identical to SEQ ID NO: 169288
  derived and/or modified sequence opt4 from neuraminidase__InfluenzaA__ADM33342

SEQ ID NO: 172176 - RNA, 1410 nt, Artificial Sequence
  derived and/or modified sequence opt4 from neuraminidase__InfluenzaA__ADM33367
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcguggugaccuacgagaacaacaccugggugaaccagaccuacgugaacaucagcaacaccaacuucgccgccggccagagcguggugagcgugaagcuggccggcaacagcagccugugccccgugggcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172177 - RNA, 1410 nt, Artificial Sequence; identical to SEQ ID NO: 169288
  derived and/or modified sequence opt4 from neuraminidase__InfluenzaA__ADM33377

SEQ ID NO: 172178 - RNA, 1410 nt, Artificial Sequence; identical to SEQ ID NO: 169288
  derived and/or modified sequence opt4 from neuraminidase__InfluenzaA__ADM33387

SEQ ID NO: 172179 - RNA, 1410 nt, Artificial Sequence; identical to SEQ ID NO: 169258
  derived and/or modified sequence opt4 from neuraminidase__InfluenzaA__ADM33397

SEQ ID NO: 172180 - RNA, 1410 nt, Artificial Sequence; identical to SEQ ID NO: 169258
  derived and/or modified sequence opt4 from neuraminidase__InfluenzaA__ADM33407

SEQ ID NO: 172181 - RNA, 1410 nt, Artificial Sequence; identical to SEQ ID NO: 169288
  derived and/or modified sequence opt4 from neuraminidase__InfluenzaA__ADM33417

SEQ ID NO: 172182 - RNA, 1410 nt, Artificial Sequence; identical to SEQ ID NO: 169258
  derived and/or modified sequence opt4 from neuraminidase__InfluenzaA__ADM33427

SEQ ID NO: 172183 - RNA, 1410 nt, Artificial Sequence
  derived and/or modified sequence opt4 from neuraminidase__InfluenzaA__ADM33437
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagcgccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172184 - RNA, 1410 nt, Artificial Sequence; identical to SEQ ID NO: 169612
  derived and/or modified sequence opt4 from neuraminidase__InfluenzaA__ADM33443

SEQ ID NO: 172185 - RNA, 1410 nt, Artificial Sequence; identical to SEQ ID NO: 169258
  derived and/or modified sequence opt4 from neuraminidase__InfluenzaA__ADM52446

SEQ ID NO: 172186 - RNA, 1410 nt, Artificial Sequence; identical to SEQ ID NO: 169258
  derived and/or modified sequence opt4 from neuraminidase__InfluenzaA__ADM52456

SEQ ID NO: 172187 - RNA, 1410 nt, Artificial Sequence; identical to SEQ ID NO: 171463
  derived and/or modified sequence opt4 from neuraminidase__InfluenzaA__ADM52466

SEQ ID NO: 172188 - RNA, 1410 nt, Artificial Sequence; identical to SEQ ID NO: 169258
  derived and/or modified sequence opt4 from neuraminidase__InfluenzaA__ADM52486

SEQ ID NO: 172189 - RNA, 1410 nt, Artificial Sequence; identical to SEQ ID NO: 169248
  derived and/or modified sequence opt4 from neuraminidase__InfluenzaA__ADM52496

SEQ ID NO: 172190 - RNA, 1410 nt, Artificial Sequence; identical to SEQ ID NO: 169258
  derived and/or modified sequence opt4 from neuraminidase__InfluenzaA__ADM52506

SEQ ID NO: 172191 - RNA, 1410 nt, Artificial Sequence; identical to SEQ ID NO: 169248
  derived and/or modified sequence opt4 from neuraminidase__InfluenzaA__ADM52516

SEQ ID NO: 172192 - RNA, 1410 nt, Artificial Sequence; identical to SEQ ID NO: 169248
  derived and/or modified sequence opt4 from neuraminidase__InfluenzaA__ADM52527

SEQ ID NO: 172193 - RNA, 1410 nt, Artificial Sequence; identical to SEQ ID NO: 170481
  derived and/or modified sequence opt4 from neuraminidase__InfluenzaA__ADM52537

SEQ ID NO: 172194 - RNA, 1410 nt, Artificial Sequence; identical to SEQ ID NO: 170982
  derived and/or modified sequence opt4 from neuraminidase__InfluenzaA__ADM52547

SEQ ID NO: 172195 - RNA, 1410 nt, Artificial Sequence; identical to SEQ ID NO: 169248
  derived and/or modified sequence opt4 from neuraminidase__InfluenzaA__ADM52557

SEQ ID NO: 172196 - RNA, 1410 nt, Artificial Sequence; identical to SEQ ID NO: 169248
  derived and/or modified sequence opt4 from neuraminidase__InfluenzaA__ADM52567

SEQ ID NO: 172197 - RNA, 1410 nt, Artificial Sequence; identical to SEQ ID NO: 169248
  derived and/or modified sequence opt4 from neuraminidase__InfluenzaA__ADM52577

SEQ ID NO: 172198 - RNA, 1410 nt, Artificial Sequence; identical to SEQ ID NO: 169258
  derived and/or modified sequence opt4 from neuraminidase__InfluenzaA__ADM52587

SEQ ID NO: 172199 - RNA, 1410 nt, Artificial Sequence; identical to SEQ ID NO: 169258
  derived and/or modified sequence opt4 from neuraminidase__InfluenzaA__ADM52597

SEQ ID NO: 172200 - RNA, 1410 nt, Artificial Sequence; identical to SEQ ID NO: 169248
  derived and/or modified sequence opt4 from neuraminidase__InfluenzaA__ADM52607

SEQ ID NO: 172201 - RNA, 1410 nt, Artificial Sequence; identical to SEQ ID NO: 169248
  derived and/or modified sequence opt4 from neuraminidase__InfluenzaA__ADM52617

SEQ ID NO: 172202 - RNA, 1410 nt, Artificial Sequence; identical to SEQ ID NO: 170939
  derived and/or modified sequence opt4 from neuraminidase__InfluenzaA__ADM52627

SEQ ID NO: 172203 - RNA, 1410 nt, Artificial Sequence; identical to SEQ ID NO: 170481
  derived and/or modified sequence opt4 from neuraminidase__InfluenzaA__ADM52637

SEQ ID NO: 172204 - RNA, 1410 nt, Artificial Sequence; identical to SEQ ID NO: 170481
  derived and/or modified sequence opt4 from neuraminidase__InfluenzaA__ADM52647

SEQ ID NO: 172205 - RNA, 1410 nt, Artificial Sequence; identical to SEQ ID NO: 169248
  derived and/or modified sequence opt4 from neuraminidase__InfluenzaA__ADM52657

SEQ ID NO: 172206 - RNA, 1410 nt, Artificial Sequence; identical to SEQ ID NO: 170481
  derived and/or modified sequence opt4 from neuraminidase__InfluenzaA__ADM52667

SEQ ID NO: 172207 - RNA, 1410 nt, Artificial Sequence; identical to SEQ ID NO: 169248
  derived and/or modified sequence opt4 from neuraminidase__InfluenzaA__ADM52687

SEQ ID NO: 172208 - RNA, 1410 nt, Artificial Sequence; identical to SEQ ID NO: 169248
  derived and/or modified sequence opt4 from neuraminidase__InfluenzaA__ADM52697

SEQ ID NO: 172209 - RNA, 1410 nt, Artificial Sequence; identical to SEQ ID NO: 170939
  derived and/or modified sequence opt4 from neuraminidase__InfluenzaA__ADM52707

SEQ ID NO: 172210 - RNA, 1410 nt, Artificial Sequence
  derived and/or modified sequence opt4 from neuraminidase__InfluenzaA__ADM52717
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcgccgugagcgugaagcuggugggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172211 - RNA, 1410 nt, Artificial Sequence
  derived and/or modified sequence opt4 from neuraminidase__InfluenzaA__ADM86402
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggccagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccgugaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172212 - RNA, 1410 nt, Artificial Sequence; identical to SEQ ID NO: 169258
  derived and/or modified sequence opt4 from neuraminidase__InfluenzaA__ADM86412

SEQ ID NO: 172213 - RNA, 1410 nt, Artificial Sequence
  derived and/or modified sequence opt4 from neuraminidase__InfluenzaA__ADM86422
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucguggccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagguggugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172214 - RNA, 1410 nt, Artificial Sequence; identical to SEQ ID NO: 170112
  derived and/or modified sequence opt4 from neuraminidase__InfluenzaA__ADM86432

SEQ ID NO: 172215 - RNA, 1410 nt, Artificial Sequence
  derived and/or modified sequence opt4 from neuraminidase__InfluenzaA__ADM86443
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172216 - RNA, 1410 nt, Artificial Sequence; identical to SEQ ID NO: 169841
  derived and/or modified sequence opt4 from neuraminidase__InfluenzaA__ADM86453

SEQ ID NO: 172217 - RNA, 1350 nt, Artificial Sequence
  derived and/or modified sequence opt4 from neuraminidase__InfluenzaA__ADM95377
augaaccccaaccagaagaucaucaccaucggcagcaucugcauggugaccggcaucgugagccugaugcugcaggugggcagcaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccaugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagauucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 172218 - RNA, 1410 nt, Artificial Sequence; identical to SEQ ID NO: 169258
  derived and/or modified sequence opt4 from neuraminidase__InfluenzaA__ADM95650

SEQ ID NO: 172219 - RNA, 1410 nt, Artificial Sequence; identical to SEQ ID NO: 169258
  derived and/or modified sequence opt4 from neuraminidase__InfluenzaA__ADM95651

SEQ ID NO: 172220 - RNA, 1410 nt, Artificial Sequence
  derived and/or modified sequence opt4 from neuraminidase__InfluenzaA__ADM95652
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaaguucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcaacugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172221 - RNA, 1410 nt, Artificial Sequence
  derived and/or modified sequence opt4 from neuraminidase__InfluenzaA__ADM95654
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagacacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172222 - RNA, 1410 nt, Artificial Sequence
  derived and/or modified sequence opt4 from neuraminidase__InfluenzaA__ADM95655
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccagcgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacgacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172223 - RNA, 1410 nt, Artificial Sequence; identical to SEQ ID NO: 170870
  derived and/or modified sequence opt4 from neuraminidase__InfluenzaA__ADM95656

SEQ ID NO: 172224 - RNA, 1410 nt, Artificial Sequence; identical to SEQ ID NO: 170435
  derived and/or modified sequence opt4 from neuraminidase__InfluenzaA__ADM95658

SEQ ID NO: 172225 - RNA, 1410 nt, Artificial Sequence
  derived and/or modified sequence opt4 from neuraminidase__InfluenzaA__ADM95659
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaagcggcuucgagaugaucugggaccccaacggcuggaccggcaccgacaacaacuucagcaucaagcaggacaucaucggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172226 - RNA, 1410 nt, Artificial Sequence; identical to SEQ ID NO: 169258
  derived and/or modified sequence opt4 from neuraminidase__InfluenzaA__ADM95660

SEQ ID NO: 172227 - RNA, 1410 nt, Artificial Sequence
  derived and/or modified sequence opt4 from neuraminidase__InfluenzaA__ADM95661
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 172228 - RNA, 1410 nt, Artificial Sequence; identical to SEQ ID NO: 170870
  derived and/or modified sequence opt4 from neuraminidase__InfluenzaA__ADM95662

SEQ ID NO: 172229 - RNA, 1410 nt, Artificial Sequence
  derived and/or modified sequence opt4 from neuraminidase__InfluenzaA__ADM95663
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcaucgagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 172230 - RNA, 1410 nt, Artificial Sequence; identical to SEQ ID NO: 170870
  derived and/or modified sequence opt4 from neuraminidase__InfluenzaA__ADM95664

SEQ ID NO: 172231 - RNA, 1410 nt, Artificial Sequence; identical to SEQ ID NO: 170870
  derived and/or modified sequence opt4 from neuraminidase__InfluenzaA__ADM95665

SEQ ID NO: 172232 - RNA, 1410 nt, Artificial Sequence
  derived and/or modified sequence opt4 from neuraminidase__InfluenzaA__ADM95666
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcuucaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 172233 - RNA, 1410 nt, Artificial Sequence; identical to SEQ ID NO: 170870
  derived and/or modified sequence opt4 from neuraminidase__InfluenzaA__ADM95667

SEQ ID NO: 172234 - RNA, 1410 nt, Artificial Sequence; identical to SEQ ID NO: 170870
  derived and/or modified sequence opt4 from neuraminidase__InfluenzaA__ADM95668

SEQ ID NO: 172235 - RNA, 1410 nt, Artificial Sequence; identical to SEQ ID NO: 169258
  derived and/or modified sequence opt4 from neuraminidase__InfluenzaA__ADM95669

SEQ ID NO: 172236 - RNA, 1410 nt, Artificial Sequence; identical to SEQ ID NO: 169258
  derived and/or modified sequence opt4 from neuraminidase__InfluenzaA__ADM95670

SEQ ID NO: 172237 - RNA, 1410 nt, Artificial Sequence
  derived and/or modified sequence opt4 from neuraminidase__InfluenzaA__ADM95672
augaaccccaaccagaagaucaucaccaucggcagcgugugcaugaccaucggcauggccaaccugauccugcagaucggcaacaucaucagcaucuggaucagccacaccauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172238 - RNA, 1410 nt, Artificial Sequence; identical to SEQ ID NO: 169258
  derived and/or modified sequence opt4 from neuraminidase__InfluenzaA__ADM95673

SEQ ID NO: 172239 - RNA, 1410 nt, Artificial Sequence; identical to SEQ ID NO: 170870
  derived and/or modified sequence opt4 from neuraminidase__InfluenzaA__ADM95674

SEQ ID NO: 172240 - RNA, 1410 nt, Artificial Sequence; identical to SEQ ID NO: 169258
  derived and/or modified sequence opt4 from neuraminidase__InfluenzaA__ADM95675

SEQ ID NO: 172241 - RNA, 1410 nt, Artificial Sequence
  derived and/or modified sequence opt4 from neuraminidase__InfluenzaA__ADM95677
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 172242 - RNA, 1410 nt, Artificial Sequence
  derived and/or modified sequence opt4 from neuraminidase__InfluenzaA__ADM95678
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaaguucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172243 - RNA, 1410 nt, Artificial Sequence; identical to SEQ ID NO: 172241
  derived and/or modified sequence opt4 from neuraminidase__InfluenzaA__ADM95679

SEQ ID NO: 172244 - RNA, 1410 nt, Artificial Sequence; identical to SEQ ID NO: 172241
  derived and/or modified sequence opt4 from neuraminidase__InfluenzaA__ADM95680

SEQ ID NO: 172245 - RNA, 1410 nt, Artificial Sequence; identical to SEQ ID NO: 169258
  derived and/or modified sequence opt4 from neuraminidase__InfluenzaA__ADM95681

SEQ ID NO: 172246 - RNA, 1410 nt, Artificial Sequence
  derived and/or modified sequence opt4 from neuraminidase__InfluenzaA__ADM95682
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaucugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172247 - RNA, 1410 nt, Artificial Sequence
  derived and/or modified sequence opt4 from neuraminidase__InfluenzaA__ADM95683
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaugagcuucugcggcgugaacagcgacaccgugggcuggagcuggcccgacggcgccgagcugcccuucaccaucgacaaguga

SEQ ID NO: 172248 - RNA, 1410 nt, Artificial Sequence; identical to SEQ ID NO: 169258
  derived and/or modified sequence opt4 from neuraminidase__InfluenzaA__ADM95684

SEQ ID NO: 172249 - RNA, 1410 nt, Artificial Sequence
  derived and/or modified sequence opt4 from neuraminidase__InfluenzaA__ADM95685
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagacacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 172250 - RNA, 1410 nt, Artificial Sequence
  derived and/or modified sequence opt4 from neuraminidase__InfluenzaA__ADM95686
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacgacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172251 - RNA, 1410 nt, Artificial Sequence; identical to SEQ ID NO: 169258
  derived and/or modified sequence opt4 from neuraminidase__InfluenzaA__ADM95687

SEQ ID NO: 172252 - RNA, 1410 nt, Artificial Sequence
  derived and/or modified sequence opt4 from neuraminidase__InfluenzaA__ADM95688
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccagacuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 172253 - RNA, 1410 nt, Artificial Sequence; identical to SEQ ID NO: 172250
  derived and/or modified sequence opt4 from neuraminidase__InfluenzaA__ADM95689

SEQ ID NO: 172254 - RNA, 1410 nt, Artificial Sequence
  derived and/or modified sequence opt4 from neuraminidase__InfluenzaA__ADM95690
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172255 - RNA, 1410 nt, Artificial Sequence; identical to SEQ ID NO: 169258
  derived and/or modified sequence opt4 from neuraminidase__InfluenzaA__ADM95691

SEQ ID NO: 172256 - RNA, 1410 nt, Artificial Sequence
  derived and/or modified sequence opt4 from neuraminidase__InfluenzaA__ADM95692
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucaucaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172257 - RNA, 1410 nt, Artificial Sequence; identical to SEQ ID NO: 169258
  derived and/or modified sequence opt4 from neuraminidase__InfluenzaA__ADM95693

SEQ ID NO: 172258 - RNA, 1410 nt, Artificial Sequence; identical to SEQ ID NO: 169258
  derived and/or modified sequence opt4 from neuraminidase__InfluenzaA__ADM95694

SEQ ID NO: 172259 - RNA, 1410 nt, Artificial Sequence; identical to SEQ ID NO: 169258
  derived and/or modified sequence opt4 from neuraminidase__InfluenzaA__ADM95695

SEQ ID NO: 172260 - RNA, 1410 nt, Artificial Sequence; identical to SEQ ID NO: 172250
  derived and/or modified sequence opt4 from neuraminidase__InfluenzaA__ADM95696

SEQ ID NO: 172261 - RNA, 1410 nt, Artificial Sequence; identical to SEQ ID NO: 170870
  derived and/or modified sequence opt4 from neuraminidase__InfluenzaA__ADM95697

SEQ ID NO: 172262 - RNA, 1413 nt, Artificial Sequence
  derived and/or modified sequence opt4 from neuraminidase__InfluenzaA__ADM95698
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacaacaccugggugaaccacaccuacgugaacaucaacaacaccaacgugguggccgaggaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccagcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172263 - RNA, 1413 nt, Artificial Sequence
  derived and/or modified sequence opt4 from neuraminidase__InfluenzaA__ADM95699
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacaacaccugggugaaccacaccuacgugaacaucaacaacaccaacgugguggccgaggaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172264 - RNA, 1413 nt, Artificial Sequence
  derived and/or modified sequence opt4 from neuraminidase__InfluenzaA__ADM95701
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacaacaccugggugaaccacaccuacgugaacaucaacaacaccaacgugguggccgaggaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172265 - RNA, 1413 nt, Artificial Sequence
  derived and/or modified sequence opt4 from neuraminidase__InfluenzaA__ADM95702
augaaccccaaccagaagaucaucaccaucggcagcaucagcaucgccaucggcaucaucagccugaugcugcagaucggcaacaucaucagcaucugggccagccacagcauccagaccggcagacagaacaacaccggcaucugcaaccagagaaucaucaccuacgagaacagcaccugggugaaccacaccuacgugaacaucaacaacaccaaggugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgaggugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172266 - RNA, 1413 nt, Artificial Sequence
  derived and/or modified sequence opt4 from neuraminidase__InfluenzaA__ADM95704
augaaccccaaccagaagaucaucaccaucggcagcaucagcaucgccaucggcaucaucagccugaugcugcagaucggcaacaucgugagcaucugggccagccacagcauccagaccggcagccagaacaacaccggcaucugcaaccagagaaucaucaccuacgagaacaacaccugggugaaccacaccuacgugaacaucaacaacaccaacgugguggccgaggaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacagagccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172267 - RNA, 1413 nt, Artificial Sequence
  derived and/or modified sequence opt4 from neuraminidase__InfluenzaA__ADM95705
augaaccccaaccagaagaucaucaccaucggcagcaucagcaucgccaucggcaucaucagccugaugcugcagaucggcaacaucaucagcaucugggccagccacagcauccagaccggcagacagaacaacaccggcaucugcaaccagagaaucaucaccuacgagaacagcaccugggugaaccacaccuacgugaacaucaacaacaccaaggugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172268 - RNA, 1413 nt, Artificial Sequence; identical to SEQ ID NO: 172267
  derived and/or modified sequence opt4 from neuraminidase__InfluenzaA__ADM95706

SEQ ID NO: 172269 - RNA, 1413 nt, Artificial Sequence; identical to SEQ ID NO: 172267
  derived and/or modified sequence opt4 from neuraminidase__InfluenzaA__ADM95707

SEQ ID NO: 172270 - RNA, 1413 nt, Artificial Sequence; identical to SEQ ID NO: 169981
  derived and/or modified sequence opt4 from neuraminidase__InfluenzaA__ADM95708

SEQ ID NO: 172271 - RNA, 1410 nt, Artificial Sequence
  derived and/or modified sequence opt4 from neuraminidase__InfluenzaA__ADM95710
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacaacaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcggcaccagcggcaccuacggcaccggcagcuggcccgacggcgccgacaucaaccugaugcccaucuga

SEQ ID NO: 172272 - RNA, 1410 nt, Artificial Sequence; identical to SEQ ID NO: 169119
  derived and/or modified sequence opt4 from neuraminidase__InfluenzaA__ADM95711

SEQ ID NO: 172273 - RNA, 1410 nt, Artificial Sequence; identical to SEQ ID NO: 169119
  derived and/or modified sequence opt4 from neuraminidase__InfluenzaA__ADM95712

SEQ ID NO: 172274 - RNA, 1410 nt, Artificial Sequence; identical to SEQ ID NO: 169119
  derived and/or modified sequence opt4 from neuraminidase__InfluenzaA__ADM95713

SEQ ID NO: 172275 - RNA, 1410 nt, Artificial Sequence
  derived and/or modified sequence opt4 from neuraminidase__InfluenzaA__ADM95714
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcggcaccagcggcaccuacggcaccggcagcuggcccgacggcgccgacaucaaccugaugcccaucuga

SEQ ID NO: 172276 - RNA, 1410 nt, Artificial Sequence; identical to SEQ ID NO: 169119
  derived and/or modified sequence opt4 from neuraminidase__InfluenzaA__ADM95715

SEQ ID NO: 172277 - RNA, 1410 nt, Artificial Sequence; identical to SEQ ID NO: 172275
  derived and/or modified sequence opt4 from neuraminidase__InfluenzaA__ADM95716

SEQ ID NO: 172278 - RNA, 1410 nt, Artificial Sequence; identical to SEQ ID NO: 172275
  derived and/or modified sequence opt4 from neuraminidase__InfluenzaA__ADM95717

SEQ ID NO: 172279 - RNA, 1410 nt, Artificial Sequence; identical to SEQ ID NO: 169119
  derived and/or modified sequence opt4 from neuraminidase__InfluenzaA__ADM95718

SEQ ID NO: 172280 - RNA, 1410 nt, Artificial Sequence
  derived and/or modified sequence opt4 from neuraminidase__InfluenzaA__ADM95719
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172281 - RNA, 1410 nt, Artificial Sequence; identical to SEQ ID NO: 169119
  derived and/or modified sequence opt4 from neuraminidase__InfluenzaA__ADM95720

SEQ ID NO: 172282 - RNA, 1410 nt, Artificial Sequence; identical to SEQ ID NO: 169119
  derived and/or modified sequence opt4 from neuraminidase__InfluenzaA__ADM95721

SEQ ID NO: 172283 - RNA, 1410 nt, Artificial Sequence; identical to SEQ ID NO: 169119
  derived and/or modified sequence opt4 from neuraminidase__InfluenzaA__ADM95723

SEQ ID NO: 172284 - RNA, 1410 nt, Artificial Sequence
  derived and/or modified sequence opt4 from neuraminidase__InfluenzaA__ADM95724
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172285 - RNA, 1410 nt, Artificial Sequence
  derived and/or modified sequence opt4 from neuraminidase__InfluenzaA__ADM95725
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggaggugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaucaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcggcaccagcggcaccuacggcaccggcagcuggcccgacggcgccgacaucaaccugaugcccaucuga

SEQ ID NO: 172286 - RNA, 1410 nt, Artificial Sequence
  derived and/or modified sequence opt4 from neuraminidase__InfluenzaA__ADM95726
augaaccccaaccagaagaucaucaccaucggcagcgugagccugaccaucagcaccaucugcuucuucaugcagaucgccauccugaucaccgccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcggcaccagcggcaccuacggcaccggcagcuggcccgacggcgccgacaucaaccugaugcccaucuga

SEQ ID NO: 172287 - RNA, 1410 nt, Artificial Sequence; identical to SEQ ID NO: 169119
  derived and/or modified sequence opt4 from neuraminidase__InfluenzaA__ADM95727

SEQ ID NO: 172288 - RNA, 1410 nt, Artificial Sequence
  derived and/or modified sequence opt4 from neuraminidase__InfluenzaA__ADM95728
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccgagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172289 - RNA, 1410 nt, Artificial Sequence
  derived and/or modified sequence opt4 from neuraminidase__InfluenzaA__ADM95729
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagaagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172290 - RNA, 1410 nt, Artificial Sequence
  derived and/or modified sequence opt4 from neuraminidase__InfluenzaA__ADM95730
augaaccccaaccagaagaucaucaccaucggcagcgugagccugaccaucagcaccaucugcuucuucaugcagaucgccauccugaucaccaccgugacccugcacuucaagcaguacgaguucaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172291 - RNA, 1410 nt, Artificial Sequence
  derived and/or modified sequence opt4 from neuraminidase__InfluenzaA__ADM95732
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacagaagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172292 - RNA, 1410 nt, Artificial Sequence; identical to SEQ ID NO: 169119
  derived and/or modified sequence opt4 from neuraminidase__InfluenzaA__ADM95733

SEQ ID NO: 172293 - RNA, 1410 nt, Artificial Sequence; identical to SEQ ID NO: 169119
  derived and/or modified sequence opt4 from neuraminidase__InfluenzaA__ADM95734

SEQ ID NO: 172294 - RNA, 1410 nt, Artificial Sequence; identical to SEQ ID NO: 169119
  derived and/or modified sequence opt4 from neuraminidase__InfluenzaA__ADM95735

SEQ ID NO: 172295 - RNA, 1410 nt, Artificial Sequence; identical to SEQ ID NO: 169119
  derived and/or modified sequence opt4 from neuraminidase__InfluenzaA__ADM95736

SEQ ID NO: 172296 - RNA, 1410 nt, Artificial Sequence
  derived and/or modified sequence opt4 from neuraminidase__InfluenzaA__ADM95737
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcagagccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcggcaccagcggcaccuacggcaccggcagcuggcccgacggcgccgacaucaaccugaugcccaucuga

SEQ ID NO: 172297 - RNA, 1410 nt, Artificial Sequence; identical to SEQ ID NO: 169119
  derived and/or modified sequence opt4 from neuraminidase__InfluenzaA__ADM95738

SEQ ID NO: 172298 - RNA, 1410 nt, Artificial Sequence; identical to SEQ ID NO: 169119
  derived and/or modified sequence opt4 from neuraminidase__InfluenzaA__ADM95739

SEQ ID NO: 172299 - RNA, 1410 nt, Artificial Sequence
  derived and/or modified sequence opt4 from neuraminidase__InfluenzaA__ADM95740
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccaaggugcuguggaccagcaacagcaucgugguguucugcggcaccagcggcaccuacggcaccggcagcuggcccgacggcgccgacaucaaccugaugcccaucuga

SEQ ID NO: 172300 - RNA, 1410 nt, Artificial Sequence; identical to SEQ ID NO: 172275
  derived and/or modified sequence opt4 from neuraminidase__InfluenzaA__ADM95741

SEQ ID NO: 172301 - RNA, 1410 nt, Artificial Sequence; identical to SEQ ID NO: 169119
  derived and/or modified sequence opt4 from neuraminidase__InfluenzaA__ADM95742

SEQ ID NO: 172302 - RNA, 1410 nt, Artificial Sequence
  derived and/or modified sequence opt4 from neuraminidase__InfluenzaA__ADM95743
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172303 - RNA, 1410 nt, Artificial Sequence; identical to SEQ ID NO: 169119
  derived and/or modified sequence opt4 from neuraminidase__InfluenzaA__ADM95744

SEQ ID NO: 172304 - RNA, 1410 nt, Artificial Sequence; identical to SEQ ID NO: 169258
  derived and/or modified sequence opt4 from neuraminidase__InfluenzaA__ADN05229

SEQ ID NO: 172305 - RNA, 1413 nt, Artificial Sequence; identical to SEQ ID NO: 169981
  derived and/or modified sequence opt4 from neuraminidase__InfluenzaA__ADN06292

SEQ ID NO: 172306 - RNA, 1413 nt, Artificial Sequence; identical to SEQ ID NO: 171450
  derived and/or modified sequence opt4 from neuraminidase__InfluenzaA__ADN06303

SEQ ID NO: 172307 - RNA, 1413 nt, Artificial Sequence
  derived and/or modified sequence opt4 from neuraminidase__InfluenzaA__ADN06314
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgagguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 172308 - RNA, 1413 nt, Artificial Sequence; identical to SEQ ID NO: 171450
  derived and/or modified sequence opt4 from neuraminidase__InfluenzaA__ADN06325

SEQ ID NO: 172309 - RNA, 1413 nt, Artificial Sequence
  derived and/or modified sequence opt4 from neuraminidase__InfluenzaA__ADN06347
augaaccccaaccagaagaucaucaccaucggcagcaucagcaucgccaucggcaucaucagccugaugcugcagaucggcaacaucaucagcaucugggccagccacagcauccagaccgagagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaugggcuacaucugcagcggcguguucggcgacaaccccagacccgaggacggcgagggcagcugcaaccccgugaacguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172310 - RNA, 1410 nt, Artificial Sequence; identical to SEQ ID NO: 171930
  derived and/or modified sequence opt4 from neuraminidase__InfluenzaA__ADN06369

SEQ ID NO: 172311 - RNA, 1410 nt, Artificial Sequence; identical to SEQ ID NO: 169258
  derived and/or modified sequence opt4 from neuraminidase__InfluenzaA__ADN26031

SEQ ID NO: 172312 - RNA, 1410 nt, Artificial Sequence; identical to SEQ ID NO: 169258
  derived and/or modified sequence opt4 from neuraminidase__InfluenzaA__ADN26032

SEQ ID NO: 172313 - RNA, 1410 nt, Artificial Sequence; identical to SEQ ID NO: 169258
  derived and/or modified sequence opt4 from neuraminidase__InfluenzaA__ADN26033

SEQ ID NO: 172314 - RNA, 1410 nt, Artificial Sequence; identical to SEQ ID NO: 169258
  derived and/or modified sequence opt4 from neuraminidase__InfluenzaA__ADN26034

SEQ ID NO: 172315 - RNA, 1410 nt, Artificial Sequence; identical to SEQ ID NO: 169258
  derived and/or modified sequence opt4 from neuraminidase__InfluenzaA__ADN26035

SEQ ID NO: 172316 - RNA, 1410 nt, Artificial Sequence; identical to SEQ ID NO: 169258
  derived and/or modified sequence opt4 from neuraminidase__InfluenzaA__ADN26036

SEQ ID NO: 172317 - RNA, 1410 nt, Artificial Sequence
  derived and/or modified sequence opt4 from neuraminidase__InfluenzaA__ADN26037
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaucgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172318 - RNA, 1410 nt, Artificial Sequence; identical to SEQ ID NO: 169258
  derived and/or modified sequence opt4 from neuraminidase__InfluenzaA__ADN26038

SEQ ID NO: 172319 - RNA, 1410 nt, Artificial Sequence; identical to SEQ ID NO: 169258
  derived and/or modified sequence opt4 from neuraminidase__InfluenzaA__ADN26041

SEQ ID NO: 172320 - RNA, 1410 nt, Artificial Sequence; identical to SEQ ID NO: 169258
  derived and/or modified sequence opt4 from neuraminidase__InfluenzaA__ADN26042

SEQ ID NO: 172321 - RNA, 1410 nt, Artificial Sequence
  derived and/or modified sequence opt4 from neuraminidase__InfluenzaA__ADN26043
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccaggugggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172322 - RNA, 1410 nt, Artificial Sequence; identical to SEQ ID NO: 169258
  derived and/or modified sequence opt4 from neuraminidase__InfluenzaA__ADN26044

SEQ ID NO: 172323 - RNA, 1410 nt, Artificial Sequence; identical to SEQ ID NO: 169258
  derived and/or modified sequence opt4 from neuraminidase__InfluenzaA__ADN26045

SEQ ID NO: 172324 - RNA, 1410 nt, Artificial Sequence
  derived and/or modified sequence opt4 from neuraminidase__InfluenzaA__ADN26047
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcauggugagcgugaagcugaccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172325 - RNA, 1410 nt, Artificial Sequence; identical to SEQ ID NO: 169258
  derived and/or modified sequence opt4 from neuraminidase__InfluenzaA__ADN26048

SEQ ID NO: 172326 - RNA, 1410 nt, Artificial Sequence; identical to SEQ ID NO: 169258
  derived and/or modified sequence opt4 from neuraminidase__InfluenzaA__ADN26049

SEQ ID NO: 172327 - RNA, 1410 nt, Artificial Sequence; identical to SEQ ID NO: 169258
  derived and/or modified sequence opt4 from neuraminidase__InfluenzaA__ADN26050

SEQ ID NO: 172328 - RNA, 1410 nt, Artificial Sequence; identical to SEQ ID NO: 169258
  derived and/or modified sequence opt4 from neuraminidase__InfluenzaA__ADN26051

SEQ ID NO: 172329 - RNA, 1410 nt, Artificial Sequence; identical to SEQ ID NO: 169258
  derived and/or modified sequence opt4 from neuraminidase__InfluenzaA__ADN26052

SEQ ID NO: 172330 - RNA, 1410 nt, Artificial Sequence; identical to SEQ ID NO: 169248
  derived and/or modified sequence opt4 from neuraminidase__InfluenzaA__ADN26053

SEQ ID NO: 172331 - RNA, 1410 nt, Artificial Sequence; identical to SEQ ID NO: 169258
  derived and/or modified sequence opt4 from neuraminidase__InfluenzaA__ADN26054

SEQ ID NO: 172332 - RNA, 1410 nt, Artificial Sequence; identical to SEQ ID NO: 169258
  derived and/or modified sequence opt4 from neuraminidase__InfluenzaA__ADN26057

SEQ ID NO: 172333 - RNA, 1410 nt, Artificial Sequence; identical to SEQ ID NO: 169258
  derived and/or modified sequence opt4 from neuraminidase__InfluenzaA__ADN26058

SEQ ID NO: 172334 - RNA, 1410 nt, Artificial Sequence; identical to SEQ ID NO: 169258
  derived and/or modified sequence opt4 from neuraminidase__InfluenzaA__ADN26059

SEQ ID NO: 172335 - RNA, 1410 nt, Artificial Sequence; identical to SEQ ID NO: 169625
  derived and/or modified sequence opt4 from neuraminidase__InfluenzaA__ADN26060

SEQ ID NO: 172336 - RNA, 1410 nt, Artificial Sequence; identical to SEQ ID NO: 169258
  derived and/or modified sequence opt4 from neuraminidase__InfluenzaA__ADN26061

SEQ ID NO: 172337 - RNA, 1410 nt, Artificial Sequence; identical to SEQ ID NO: 169258
  derived and/or modified sequence opt4 from neuraminidase__InfluenzaA__ADN26063

SEQ ID NO: 172338 - RNA, 1410 nt, Artificial Sequence; identical to SEQ ID NO: 169258
  derived and/or modified sequence opt4 from neuraminidase__InfluenzaA__ADN26064

SEQ ID NO: 172339 - RNA, 1410 nt, Artificial Sequence; identical to SEQ ID NO: 170331
  derived and/or modified sequence opt4 from neuraminidase__InfluenzaA__ADN26065

SEQ ID NO: 172340 - RNA, 1410 nt, Artificial Sequence; identical to SEQ ID NO: 169258
  derived and/or modified sequence opt4 from neuraminidase__InfluenzaA__ADN26066

SEQ ID NO: 172341 - RNA, 1410 nt, Artificial Sequence; identical to SEQ ID NO: 169258
  derived and/or modified sequence opt4 from neuraminidase__InfluenzaA__ADN26067

SEQ ID NO: 172342 - RNA, 1410 nt, Artificial Sequence; identical to SEQ ID NO: 169258
  derived and/or modified sequence opt4 from neuraminidase__InfluenzaA__ADN26069

SEQ ID NO: 172343 - RNA, 1410 nt, Artificial Sequence; identical to SEQ ID NO: 169258
  derived and/or modified sequence opt4 from neuraminidase__InfluenzaA__ADN26070

SEQ ID NO: 172344 - RNA, 1410 nt, Artificial Sequence; identical to SEQ ID NO: 169258
  derived and/or modified sequence opt4 from neuraminidase__InfluenzaA__ADN26072

SEQ ID NO: 172345 - RNA, 1410 nt, Artificial Sequence; identical to SEQ ID NO: 169258
  derived and/or modified sequence opt4 from neuraminidase__InfluenzaA__ADN26073

SEQ ID NO: 172346 - RNA, 1410 nt, Artificial Sequence; identical to SEQ ID NO: 169258
  derived and/or modified sequence opt4 from neuraminidase__InfluenzaA__ADN26075

SEQ ID NO: 172347 - RNA, 1410 nt, Artificial Sequence; identical to SEQ ID NO: 169258
  derived and/or modified sequence opt4 from neuraminidase__InfluenzaA__ADN26076

SEQ ID NO: 172348 - RNA, 1410 nt, Artificial Sequence; identical to SEQ ID NO: 169258
  derived and/or modified sequence opt4 from neuraminidase__InfluenzaA__ADN26077

SEQ ID NO: 172349 - RNA, 1410 nt, Artificial Sequence; identical to SEQ ID NO: 169258
  derived and/or modified sequence opt4 from neuraminidase__InfluenzaA__ADN26078

SEQ ID NO: 172350 - RNA, 1410 nt, Artificial Sequence; identical to SEQ ID NO: 169258
  derived and/or modified sequence opt4 from neuraminidase__InfluenzaA__ADN26079

SEQ ID NO: 172351 - RNA, 1410 nt, Artificial Sequence; identical to SEQ ID NO: 169258
  derived and/or modified sequence opt4 from neuraminidase__InfluenzaA__ADN26080

SEQ ID NO: 172352 - RNA, 1410 nt, Artificial Sequence; identical to SEQ ID NO: 169258
  derived and/or modified sequence opt4 from neuraminidase__InfluenzaA__ADN26081

SEQ ID NO: 172353 - RNA, 1410 nt, Artificial Sequence; identical to SEQ ID NO: 169258
  derived and/or modified sequence opt4 from neuraminidase__InfluenzaA__ADN26082

SEQ ID NO: 172354 - RNA, 1410 nt, Artificial Sequence; identical to SEQ ID NO: 169258
  derived and/or modified sequence opt4 from neuraminidase__InfluenzaA__ADN26083

SEQ ID NO: 172355 - RNA, 1410 nt, Artificial Sequence; identical to SEQ ID NO: 171160
  derived and/or modified sequence opt4 from neuraminidase__InfluenzaA__ADN26084

SEQ ID NO: 172356 - RNA, 1410 nt, Artificial Sequence; identical to SEQ ID NO: 169258
  derived and/or modified sequence opt4 from neuraminidase__InfluenzaA__ADN26085

SEQ ID NO: 172357 - RNA, 1410 nt, Artificial Sequence; identical to SEQ ID NO: 169258
  derived and/or modified sequence opt4 from neuraminidase__InfluenzaA__ADN26086

SEQ ID NO: 172358 - RNA, 1410 nt, Artificial Sequence; identical to SEQ ID NO: 169258
  derived and/or modified sequence opt4 from neuraminidase__InfluenzaA__ADN26087

SEQ ID NO: 172359 - RNA, 1410 nt, Artificial Sequence; identical to SEQ ID NO: 169258
  derived and/or modified sequence opt4 from neuraminidase__InfluenzaA__ADN26088

SEQ ID NO: 172360 - RNA, 1410 nt, Artificial Sequence; identical to SEQ ID NO: 169258
  derived and/or modified sequence opt4 from neuraminidase__InfluenzaA__ADN26090

SEQ ID NO: 172361 - RNA, 1410 nt, Artificial Sequence; identical to SEQ ID NO: 169258
  derived and/or modified sequence opt4 from neuraminidase__InfluenzaA__ADN26091

SEQ ID NO: 172362 - RNA, 1410 nt, Artificial Sequence; identical to SEQ ID NO: 169258
  derived and/or modified sequence opt4 from neuraminidase__InfluenzaA__ADN26092

SEQ ID NO: 172363 - RNA, 1410 nt, Artificial Sequence; identical to SEQ ID NO: 169258
  derived and/or modified sequence opt4 from neuraminidase__InfluenzaA__ADN26093

SEQ ID NO: 172364 - RNA, 1410 nt, Artificial Sequence
  derived and/or modified sequence opt4 from neuraminidase__InfluenzaA__ADN26094
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaaggacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172365 - RNA, 1410 nt, Artificial Sequence; identical to SEQ ID NO: 171160
  derived and/or modified sequence opt4 from neuraminidase__InfluenzaA__ADN26095

SEQ ID NO: 172366 - RNA, 1410 nt, Artificial Sequence
  derived and/or modified sequence opt4 from neuraminidase__InfluenzaA__ADN26096
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagaacaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172367 - RNA, 1410 nt, Artificial Sequence; identical to SEQ ID NO: 169258
  derived and/or modified sequence opt4 from neuraminidase__InfluenzaA__ADN26097

SEQ ID NO: 172368 - RNA, 1410 nt, Artificial Sequence; identical to SEQ ID NO: 169258
  derived and/or modified sequence opt4 from neuraminidase__InfluenzaA__ADN26098

SEQ ID NO: 172369 - RNA, 1410 nt, Artificial Sequence; identical to SEQ ID NO: 169258
  derived and/or modified sequence opt4 from neuraminidase__InfluenzaA__ADN26099

SEQ ID NO: 172370 - RNA, 1410 nt, Artificial Sequence; identical to SEQ ID NO: 169258
  derived and/or modified sequence opt4 from neuraminidase__InfluenzaA__ADN26100

SEQ ID NO: 172371 - RNA, 1410 nt, Artificial Sequence; identical to SEQ ID NO: 169258
  derived and/or modified sequence opt4 from neuraminidase__InfluenzaA__ADN26101

SEQ ID NO: 172372 - RNA, 1410 nt, Artificial Sequence
  derived and/or modified sequence opt4 from neuraminidase__InfluenzaA__ADN26102
augaaccccaaccagaagaucaucaccaucggcagcgugugcaugaccaucggcauggccaaccugauccugcagaucggcaacaucaucagcaucuggaucagccaccugauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacagcaucuggaccagcggcagcagcaucagcuucugcggcgugaacagcgacaccgugggcuggagcuggcccgacggcgccgagcugcccuucaccaucgacaaguga

SEQ ID NO: 172373 - RNA, 1410 nt, Artificial Sequence; identical to SEQ ID NO: 169258
  derived and/or modified sequence opt4 from neuraminidase__InfluenzaA__ADN26103

SEQ ID NO: 172374 - RNA, 1410 nt, Artificial Sequence; identical to SEQ ID NO: 169258
  derived and/or modified sequence opt4 from neuraminidase__InfluenzaA__ADN26104

SEQ ID NO: 172375 - RNA, 1410 nt, Artificial Sequence; identical to SEQ ID NO: 169258
  derived and/or modified sequence opt4 from neuraminidase__InfluenzaA__ADN26105

SEQ ID NO: 172376 - RNA, 1410 nt, Artificial Sequence; identical to SEQ ID NO: 169258
  derived and/or modified sequence opt4 from neuraminidase__InfluenzaA__ADN26106

SEQ ID NO: 172377 - RNA, 1410 nt, Artificial Sequence; identical to SEQ ID NO: 171160
  derived and/or modified sequence opt4 from neuraminidase__InfluenzaA__ADN26107

SEQ ID NO: 172378 - RNA, 1410 nt, Artificial Sequence; identical to SEQ ID NO: 171160
  derived and/or modified sequence opt4 from neuraminidase__InfluenzaA__ADN26108

SEQ ID NO: 172379 - RNA, 1410 nt, Artificial Sequence; identical to SEQ ID NO: 169258
  derived and/or modified sequence opt4 from neuraminidase__InfluenzaA__ADN26109

SEQ ID NO: 172380 - RNA, 1410 nt, Artificial Sequence; identical to SEQ ID NO: 170232
  derived and/or modified sequence opt4 from neuraminidase__InfluenzaA__ADN26110

SEQ ID NO: 172381 - RNA, 1410 nt, Artificial Sequence; identical to SEQ ID NO: 171160
  derived and/or modified sequence opt4 from neuraminidase__InfluenzaA__ADN26111

SEQ ID NO: 172382 - RNA, 1410 nt, Artificial Sequence; identical to SEQ ID NO: 170232
  derived and/or modified sequence opt4 from neuraminidase__InfluenzaA__ADN26112

SEQ ID NO: 172383 - RNA, 1410 nt, Artificial Sequence; identical to SEQ ID NO: 171160
  derived and/or modified sequence opt4 from neuraminidase__InfluenzaA__ADN26113

SEQ ID NO: 172384 - RNA, 1410 nt, Artificial Sequence
  derived and/or modified sequence opt4 from neuraminidase__InfluenzaA__ADN26114
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucaacaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172385 - RNA, 1410 nt, Artificial Sequence; identical to SEQ ID NO: 169258
  derived and/or modified sequence opt4 from neuraminidase__InfluenzaA__ADN26115

SEQ ID NO: 172386 - RNA, 1410 nt, Artificial Sequence
  derived and/or modified sequence opt4 from neuraminidase__InfluenzaA__ADN26116
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccagacuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172387 - RNA, 1410 nt, Artificial Sequence; identical to SEQ ID NO: 171160
  derived and/or modified sequence opt4 from neuraminidase__InfluenzaA__ADN26117

SEQ ID NO: 172388 - RNA, 1410 nt, Artificial Sequence; identical to SEQ ID NO: 171160
  derived and/or modified sequence opt4 from neuraminidase__InfluenzaA__ADN26118

SEQ ID NO: 172389 - RNA, 1410 nt, Artificial Sequence; identical to SEQ ID NO: 169258
  derived and/or modified sequence opt4 from neuraminidase__InfluenzaA__ADN26119

SEQ ID NO: 172390 - RNA, 1410 nt, Artificial Sequence; identical to SEQ ID NO: 170232
  derived and/or modified sequence opt4 from neuraminidase__InfluenzaA__ADN26120

SEQ ID NO: 172391 - RNA, 1410 nt, Artificial Sequence; identical to SEQ ID NO: 171160
  derived and/or modified sequence opt4 from neuraminidase__InfluenzaA__ADN26121

SEQ ID NO: 172392 - RNA, 1410 nt, Artificial Sequence; identical to SEQ ID NO: 169258
  derived and/or modified sequence opt4 from neuraminidase__InfluenzaA__ADN26122

SEQ ID NO: 172393 - RNA, 1410 nt, Artificial Sequence; identical to SEQ ID NO: 169258
  derived and/or modified sequence opt4 from neuraminidase__InfluenzaA__ADN26123

SEQ ID NO: 172394 - RNA, 1410 nt, Artificial Sequence; identical to SEQ ID NO: 169258
  derived and/or modified sequence opt4 from neuraminidase__InfluenzaA__ADN26124

SEQ ID NO: 172395 - RNA, 1410 nt, Artificial Sequence; identical to SEQ ID NO: 170232
  derived and/or modified sequence opt4 from neuraminidase__InfluenzaA__ADN26125

SEQ ID NO: 172396 - RNA, 1410 nt, Artificial Sequence; identical to SEQ ID NO: 170232
  derived and/or modified sequence opt4 from neuraminidase__InfluenzaA__ADN26126

SEQ ID NO: 172397 - RNA, 1410 nt, Artificial Sequence; identical to SEQ ID NO: 170023
  derived and/or modified sequence opt4 from neuraminidase__InfluenzaA__ADN26127

SEQ ID NO: 172398 - RNA, 1410 nt, Artificial Sequence; identical to SEQ ID NO: 169258
  derived and/or modified sequence opt4 from neuraminidase__InfluenzaA__ADN26128

SEQ ID NO: 172399 - RNA, 1410 nt, Artificial Sequence; identical to SEQ ID NO: 170232
  derived and/or modified sequence opt4 from neuraminidase__InfluenzaA__ADN26129

SEQ ID NO: 172400 - RNA, 1410 nt, Artificial Sequence; identical to SEQ ID NO: 171160
  derived and/or modified sequence opt4 from neuraminidase__InfluenzaA__ADN26130

SEQ ID NO: 172401 - RNA, 1410 nt, Artificial Sequence
  derived and/or modified sequence opt4 from neuraminidase__InfluenzaA__ADN26131
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagccugugcggcgugaacagcgacaccgugggcuggagcuggcccgacggcgccgagcugcccuucaccaucgacaaguga

SEQ ID NO: 172402 - RNA, 1410 nt, Artificial Sequence; identical to SEQ ID NO: 171160
  derived and/or modified sequence opt4 from neuraminidase__InfluenzaA__ADN26132

SEQ ID NO: 172403 - RNA, 1410 nt, Artificial Sequence; identical to SEQ ID NO: 170232
  derived and/or modified sequence opt4 from neuraminidase__InfluenzaA__ADN26134

SEQ ID NO: 172404 - RNA, 1410 nt, Artificial Sequence; identical to SEQ ID NO: 169258
  derived and/or modified sequence opt4 from neuraminidase__InfluenzaA__ADN26135

SEQ ID NO: 172405 - RNA, 1410 nt, Artificial Sequence; identical to SEQ ID NO: 169258
  derived and/or modified sequence opt4 from neuraminidase__InfluenzaA__ADN26136

SEQ ID NO: 172406 - RNA, 1410 nt, Artificial Sequence; identical to SEQ ID NO: 169258
  derived and/or modified sequence opt4 from neuraminidase__InfluenzaA__ADN26137

SEQ ID NO: 172407 - RNA, 1410 nt, Artificial Sequence; identical to SEQ ID NO: 171160
  derived and/or modified sequence opt4 from neuraminidase__InfluenzaA__ADN26138

SEQ ID NO: 172408 - RNA, 1410 nt, Artificial Sequence; identical to SEQ ID NO: 170232
  derived and/or modified sequence opt4 from neuraminidase__InfluenzaA__ADN26140

SEQ ID NO: 172409 - RNA, 1410 nt, Artificial Sequence
  derived and/or modified sequence opt4 from neuraminidase__InfluenzaA__ADN26141
augaaccccaaccagaagaucaucaccaucggcagcgugugcaugaccaucggcauggccaaccugauccugcagaucggcaacaucaucagcaucuggaucagccacagcauccagcugggcaaccagaacagaaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172410 - RNA, 1410 nt, Artificial Sequence
  derived and/or modified sequence opt4 from neuraminidase__InfluenzaA__ADN26142
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaacaacuucgccgccggccagagcguggugagcgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172411 - RNA, 1410 nt, Artificial Sequence; identical to SEQ ID NO: 169258
  derived and/or modified sequence opt4 from neuraminidase__InfluenzaA__ADN26143

SEQ ID NO: 172412 - RNA, 1410 nt, Artificial Sequence; identical to SEQ ID NO: 171160
  derived and/or modified sequence opt4 from neuraminidase__InfluenzaA__ADN26144

SEQ ID NO: 172413 - RNA, 1410 nt, Artificial Sequence; identical to SEQ ID NO: 171160
  derived and/or modified sequence opt4 from neuraminidase__InfluenzaA__ADN26145

SEQ ID NO: 172414 - RNA, 1410 nt, Artificial Sequence; identical to SEQ ID NO: 169258
  derived and/or modified sequence opt4 from neuraminidase__InfluenzaA__ADN26146

SEQ ID NO: 172415 - RNA, 1410 nt, Artificial Sequence; identical to SEQ ID NO: 171160
  derived and/or modified sequence opt4 from neuraminidase__InfluenzaA__ADN26147

SEQ ID NO: 172416 - RNA, 1410 nt, Artificial Sequence; identical to SEQ ID NO: 169258
  derived and/or modified sequence opt4 from neuraminidase__InfluenzaA__ADN26148

SEQ ID NO: 172417 - RNA, 1410 nt, Artificial Sequence; identical to SEQ ID NO: 171160
  derived and/or modified sequence opt4 from neuraminidase__InfluenzaA__ADN26149

SEQ ID NO: 172418 - RNA, 1410 nt, Artificial Sequence
  derived and/or modified sequence opt4 from neuraminidase__InfluenzaA__ADN26150
augaaccccaaccagaagaucaucaccaucggcagcgugugcaugaccaucggcauggccagccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172419 - RNA, 1410 nt, Artificial Sequence; identical to SEQ ID NO: 170232
  derived and/or modified sequence opt4 from neuraminidase__InfluenzaA__ADN26151

SEQ ID NO: 172420 - RNA, 1410 nt, Artificial Sequence
  derived and/or modified sequence opt4 from neuraminidase__InfluenzaA__ADN26152
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcaugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccagaaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172421 - RNA, 1410 nt, Artificial Sequence; identical to SEQ ID NO: 171160
  derived and/or modified sequence opt4 from neuraminidase__InfluenzaA__ADN26153

SEQ ID NO: 172422 - RNA, 1410 nt, Artificial Sequence; identical to SEQ ID NO: 169841
  derived and/or modified sequence opt4 from neuraminidase__InfluenzaA__ADN26154

SEQ ID NO: 172423 - RNA, 1410 nt, Artificial Sequence; identical to SEQ ID NO: 169258
  derived and/or modified sequence opt4 from neuraminidase__InfluenzaA__ADN26155

SEQ ID NO: 172424 - RNA, 1410 nt, Artificial Sequence; identical to SEQ ID NO: 170232
  derived and/or modified sequence opt4 from neuraminidase__InfluenzaA__ADN26157

SEQ ID NO: 172425 - RNA, 1410 nt, Artificial Sequence; identical to SEQ ID NO: 169258
  derived and/or modified sequence opt4 from neuraminidase__InfluenzaA__ADN26159

SEQ ID NO: 172426 - RNA, 1410 nt, Artificial Sequence; identical to SEQ ID NO: 169258
  derived and/or modified sequence opt4 from neuraminidase__InfluenzaA__ADN26161

SEQ ID NO: 172427 - RNA, 1410 nt, Artificial Sequence
  derived and/or modified sequence opt4 from neuraminidase__InfluenzaA__ADN26162
augaaccccaaccagaagaucaucaccaucagcagcgugugcaugaccgugggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172428 - RNA, 1410 nt, Artificial Sequence
  derived and/or modified sequence opt4 from neuraminidase__InfluenzaA__ADN26163
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaucaucgacaaguga

SEQ ID NO: 172429 - RNA, 1410 nt, Artificial Sequence
  derived and/or modified sequence opt4 from neuraminidase__InfluenzaA__ADN26164
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugccugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacgacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172430 - RNA, 1410 nt, Artificial Sequence; identical to SEQ ID NO: 171215
  derived and/or modified sequence opt4 from neuraminidase__InfluenzaA__ADN26168

SEQ ID NO: 172431 - RNA, 1410 nt, Artificial Sequence; identical to SEQ ID NO: 170481
  derived and/or modified sequence opt4 from neuraminidase__InfluenzaA__ADN26178

SEQ ID NO: 172432 - RNA, 1410 nt, Artificial Sequence; identical to SEQ ID NO: 169258
  derived and/or modified sequence opt4 from neuraminidase__InfluenzaA__ADN26868

SEQ ID NO: 172433 - RNA, 1410 nt, Artificial Sequence; identical to SEQ ID NO: 169258
  derived and/or modified sequence opt4 from neuraminidase__InfluenzaA__ADN26869

SEQ ID NO: 172434 - RNA, 1410 nt, Artificial Sequence; identical to SEQ ID NO: 169258
  derived and/or modified sequence opt4 from neuraminidase__InfluenzaA__ADN26870

SEQ ID NO: 172435 - RNA, 1410 nt, Artificial Sequence
  derived and/or modified sequence opt4 from neuraminidase__InfluenzaA__ADN26871
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccuacaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172436 - RNA, 1410 nt, Artificial Sequence
  derived and/or modified sequence opt4 from neuraminidase__InfluenzaA__ADN26872
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccugagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172437 - RNA, 1410 nt, Artificial Sequence; identical to SEQ ID NO: 169258
  derived and/or modified sequence opt4 from neuraminidase__InfluenzaA__ADN26873

SEQ ID NO: 172438 - RNA, 1410 nt, Artificial Sequence; identical to SEQ ID NO: 169258
  derived and/or modified sequence opt4 from neuraminidase__InfluenzaA__ADN26874

SEQ ID NO: 172439 - RNA, 1410 nt, Artificial Sequence; identical to SEQ ID NO: 169258
  derived and/or modified sequence opt4 from neuraminidase__InfluenzaA__ADN26875

SEQ ID NO: 172440 - RNA, 1410 nt, Artificial Sequence; identical to SEQ ID NO: 169258
  derived and/or modified sequence opt4 from neuraminidase__InfluenzaA__ADN26876

SEQ ID NO: 172441 - RNA, 1410 nt, Artificial Sequence; identical to SEQ ID NO: 169258
  derived and/or modified sequence opt4 from neuraminidase__InfluenzaA__ADN26877

SEQ ID NO: 172442 - RNA, 1410 nt, Artificial Sequence; identical to SEQ ID NO: 169258
  derived and/or modified sequence opt4 from neuraminidase__InfluenzaA__ADN26878

SEQ ID NO: 172443 - RNA, 1410 nt, Artificial Sequence; identical to SEQ ID NO: 170395
  derived and/or modified sequence opt4 from neuraminidase__InfluenzaA__ADN26879

SEQ ID NO: 172444 - RNA, 1410 nt, Artificial Sequence; identical to SEQ ID NO: 169258
  derived and/or modified sequence opt4 from neuraminidase__InfluenzaA__ADN26880

SEQ ID NO: 172445 - RNA, 1410 nt, Artificial Sequence; identical to SEQ ID NO: 169258
  derived and/or modified sequence opt4 from neuraminidase__InfluenzaA__ADN26881

SEQ ID NO: 172446 - RNA, 1410 nt, Artificial Sequence; identical to SEQ ID NO: 169258
  derived and/or modified sequence opt4 from neuraminidase__InfluenzaA__ADN26882

SEQ ID NO: 172447 - RNA, 1410 nt, Artificial Sequence; identical to SEQ ID NO: 169258
  derived and/or modified sequence opt4 from neuraminidase__InfluenzaA__ADN26883

SEQ ID NO: 172448 - RNA, 1413 nt, Artificial Sequence
  derived and/or modified sequence opt4 from neuraminidase__InfluenzaA__ADN89064
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaagaggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172449 - RNA, 1413 nt, Artificial Sequence; identical to SEQ ID NO: 169981
  derived and/or modified sequence opt4 from neuraminidase__InfluenzaA__ADN89075

SEQ ID NO: 172450 - RNA, 1413 nt, Artificial Sequence
  derived and/or modified sequence opt4 from neuraminidase__InfluenzaA__ADN89086
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaagaccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172451 - RNA, 1413 nt, Artificial Sequence; identical to SEQ ID NO: 169981
  derived and/or modified sequence opt4 from neuraminidase__InfluenzaA__ADN89097

SEQ ID NO: 172452 - RNA, 1413 nt, Artificial Sequence
  derived and/or modified sequence opt4 from neuraminidase__InfluenzaA__ADN89108
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacguggugagcaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172453 - RNA, 1413 nt, Artificial Sequence
  derived and/or modified sequence opt4 from neuraminidase__InfluenzaA__ADN89119
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccgugaacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaccagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172454 - RNA, 1413 nt, Artificial Sequence
  derived and/or modified sequence opt4 from neuraminidase__InfluenzaA__ADN89130
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaacuucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 172455 - RNA, 1413 nt, Artificial Sequence; identical to SEQ ID NO: 172452
  derived and/or modified sequence opt4 from neuraminidase__InfluenzaA__ADN89141

SEQ ID NO: 172456 - RNA, 1413 nt, Artificial Sequence
  derived and/or modified sequence opt4 from neuraminidase__InfluenzaA__ADN89152
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccaucgacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172457 - RNA, 1413 nt, Artificial Sequence
  derived and/or modified sequence opt4 from neuraminidase__InfluenzaA__ADN89163
augaaccccaaccagagaaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172458 - RNA, 1413 nt, Artificial Sequence; identical to SEQ ID NO: 171450
  derived and/or modified sequence opt4 from neuraminidase__InfluenzaA__ADN89174

SEQ ID NO: 172459 - RNA, 1413 nt, Artificial Sequence; identical to SEQ ID NO: 172452
  derived and/or modified sequence opt4 from neuraminidase__InfluenzaA__ADN89185

SEQ ID NO: 172460 - RNA, 1413 nt, Artificial Sequence
  derived and/or modified sequence opt4 from neuraminidase__InfluenzaA__ADN89196
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaugggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagccugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172461 - RNA, 1413 nt, Artificial Sequence; identical to SEQ ID NO: 172460
  derived and/or modified sequence opt4 from neuraminidase__InfluenzaA__ADN89207

SEQ ID NO: 172462 - RNA, 1413 nt, Artificial Sequence
  derived and/or modified sequence opt4 from neuraminidase__InfluenzaA__ADN89218
augaaccccaaccagaagaucaucaccaucggcagcaucagcaucgccaucggcaucaucagccugaugcugcagaucggcaacaucaucagcaucugggccagccacagcauccagcccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 172463 - RNA, 1413 nt, Artificial Sequence
  derived and/or modified sequence opt4 from neuraminidase__InfluenzaA__ADN89229
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaccaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172464 - RNA, 1413 nt, Artificial Sequence
  derived and/or modified sequence opt4 from neuraminidase__InfluenzaA__ADN89240
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 172465 - RNA, 1413 nt, Artificial Sequence; identical to SEQ ID NO: 169981
  derived and/or modified sequence opt4 from neuraminidase__InfluenzaA__ADN89251

SEQ ID NO: 172466 - RNA, 1413 nt, Artificial Sequence; identical to SEQ ID NO: 169981
  derived and/or modified sequence opt4 from neuraminidase__InfluenzaA__ADN89262

SEQ ID NO: 172467 - RNA, 1413 nt, Artificial Sequence; identical to SEQ ID NO: 169981
  derived and/or modified sequence opt4 from neuraminidase__InfluenzaA__ADN89273

SEQ ID NO: 172468 - RNA, 1413 nt, Artificial Sequence; identical to SEQ ID NO: 169981
  derived and/or modified sequence opt4 from neuraminidase__InfluenzaA__ADN89284

SEQ ID NO: 172469 - RNA, 1413 nt, Artificial Sequence; identical to SEQ ID NO: 169981
  derived and/or modified sequence opt4 from neuraminidase__InfluenzaA__ADN89295

SEQ ID NO: 172470 - RNA, 1413 nt, Artificial Sequence; identical to SEQ ID NO: 169981
  derived and/or modified sequence opt4 from neuraminidase__InfluenzaA__ADN89306

SEQ ID NO: 172471 - RNA, 1413 nt, Artificial Sequence
  derived and/or modified sequence opt4 from neuraminidase__InfluenzaA__ADN89317
augaaccccaaccagagaaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacagcaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 172472 - RNA, 1413 nt, Artificial Sequence
  derived and/or modified sequence opt4 from neuraminidase__InfluenzaA__ADN89328
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucugggccagcggcagcagcaucagcuucugcggcgugaacagcgacaccgccaacuggagcuggcccgacggcgccgagcugcccuucaccaucgacaaguga

SEQ ID NO: 172473 - RNA, 1413 nt, Artificial Sequence; identical to SEQ ID NO: 172457
  derived and/or modified sequence opt4 from neuraminidase__InfluenzaA__ADN89339

SEQ ID NO: 172474 - RNA, 1413 nt, Artificial Sequence; identical to SEQ ID NO: 172463
  derived and/or modified sequence opt4 from neuraminidase__InfluenzaA__ADN89350

SEQ ID NO: 172475 - RNA, 1413 nt, Artificial Sequence
  derived and/or modified sequence opt4 from neuraminidase__InfluenzaA__ADN89361
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucaucaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172476 - RNA, 1413 nt, Artificial Sequence
  derived and/or modified sequence opt4 from neuraminidase__InfluenzaA__ADN89372
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacaucguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccgugaacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172477 - RNA, 1413 nt, Artificial Sequence; identical to SEQ ID NO: 172452
  derived and/or modified sequence opt4 from neuraminidase__InfluenzaA__ADN89383

SEQ ID NO: 172478 - RNA, 1413 nt, Artificial Sequence
  derived and/or modified sequence opt4 from neuraminidase__InfluenzaA__ADN89405
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaccagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172479 - RNA, 1413 nt, Artificial Sequence
  derived and/or modified sequence opt4 from neuraminidase__InfluenzaA__ADN89416
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcgugcugggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 172480 - RNA, 1413 nt, Artificial Sequence
  derived and/or modified sequence opt4 from neuraminidase__InfluenzaA__ADN89427
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacgccgccgacuggagcuggcccgacggcgccgagcugcccuucaccaucgacaaguga

SEQ ID NO: 172481 - RNA, 1413 nt, Artificial Sequence; identical to SEQ ID NO: 169981
  derived and/or modified sequence opt4 from neuraminidase__InfluenzaA__ADN89438

SEQ ID NO: 172482 - RNA, 1413 nt, Artificial Sequence
  derived and/or modified sequence opt4 from neuraminidase__InfluenzaA__ADN89449
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagcccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172483 - RNA, 1413 nt, Artificial Sequence; identical to SEQ ID NO: 171450
  derived and/or modified sequence opt4 from neuraminidase__InfluenzaA__ADN89460

SEQ ID NO: 172484 - RNA, 1413 nt, Artificial Sequence; identical to SEQ ID NO: 169981
  derived and/or modified sequence opt4 from neuraminidase__InfluenzaA__ADN89482

SEQ ID NO: 172485 - RNA, 1413 nt, Artificial Sequence
  derived and/or modified sequence opt4 from neuraminidase__InfluenzaA__ADN89493
augaaccccaaccagaagaucaucaccaucggcagcaucagcaucgccaucggcaucaucagccugaugcugcagaucggcaacaucaucagcaucugggccagccacagcauccagaccgagagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaugggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172486 - RNA, 1413 nt, Artificial Sequence; identical to SEQ ID NO: 169981
  derived and/or modified sequence opt4 from neuraminidase__InfluenzaA__ADN89504

SEQ ID NO: 172487 - RNA, 1413 nt, Artificial Sequence
  derived and/or modified sequence opt4 from neuraminidase__InfluenzaA__ADN89515
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucaccgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172488 - RNA, 1413 nt, Artificial Sequence; identical to SEQ ID NO: 169981
  derived and/or modified sequence opt4 from neuraminidase__InfluenzaA__ADN89526

SEQ ID NO: 172489 - RNA, 1413 nt, Artificial Sequence; identical to SEQ ID NO: 172452
  derived and/or modified sequence opt4 from neuraminidase__InfluenzaA__ADN89537

SEQ ID NO: 172490 - RNA, 1413 nt, Artificial Sequence; identical to SEQ ID NO: 169981
  derived and/or modified sequence opt4 from neuraminidase__InfluenzaA__ADN89548

SEQ ID NO: 172491 - RNA, 1413 nt, Artificial Sequence; identical to SEQ ID NO: 169981
  derived and/or modified sequence opt4 from neuraminidase__InfluenzaA__ADN89570

SEQ ID NO: 172492 - RNA, 1413 nt, Artificial Sequence
  derived and/or modified sequence opt4 from neuraminidase__InfluenzaA__ADN89581
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaagaccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 172493 - RNA, 1413 nt, Artificial Sequence; identical to SEQ ID NO: 171450
  derived and/or modified sequence opt4 from neuraminidase__InfluenzaA__ADN89592

SEQ ID NO: 172494 - RNA, 1413 nt, Artificial Sequence; identical to SEQ ID NO: 171450
  derived and/or modified sequence opt4 from neuraminidase__InfluenzaA__ADN89603

SEQ ID NO: 172495 - RNA, 1413 nt, Artificial Sequence; identical to SEQ ID NO: 172460
  derived and/or modified sequence opt4 from neuraminidase__InfluenzaA__ADN89614

SEQ ID NO: 172496 - RNA, 1413 nt, Artificial Sequence; identical to SEQ ID NO: 172479
  derived and/or modified sequence opt4 from neuraminidase__InfluenzaA__ADN89625

SEQ ID NO: 172497 - RNA, 1413 nt, Artificial Sequence; identical to SEQ ID NO: 169981
  derived and/or modified sequence opt4 from neuraminidase__InfluenzaA__ADN89636

SEQ ID NO: 172498 - RNA, 1413 nt, Artificial Sequence; identical to SEQ ID NO: 169981
  derived and/or modified sequence opt4 from neuraminidase__InfluenzaA__ADN89647

SEQ ID NO: 172499 - RNA, 1413 nt, Artificial Sequence; identical to SEQ ID NO: 169981
  derived and/or modified sequence opt4 from neuraminidase__InfluenzaA__ADN89658

SEQ ID NO: 172500 - RNA, 1413 nt, Artificial Sequence; identical to SEQ ID NO: 171450
  derived and/or modified sequence opt4 from neuraminidase__InfluenzaA__ADN89669

SEQ ID NO: 172501 - RNA, 1413 nt, Artificial Sequence; identical to SEQ ID NO: 169981
  derived and/or modified sequence opt4 from neuraminidase__InfluenzaA__ADN89680

SEQ ID NO: 172502 - RNA, 1413 nt, Artificial Sequence; identical to SEQ ID NO: 169981
  derived and/or modified sequence opt4 from neuraminidase__InfluenzaA__ADN89691

SEQ ID NO: 172503 - RNA, 1413 nt, Artificial Sequence; identical to SEQ ID NO: 172479
  derived and/or modified sequence opt4 from neuraminidase__InfluenzaA__ADN89702

SEQ ID NO: 172504 - RNA, 1413 nt, Artificial Sequence; identical to SEQ ID NO: 169981
  derived and/or modified sequence opt4 from neuraminidase__InfluenzaA__ADN89713

SEQ ID NO: 172505 - RNA, 1413 nt, Artificial Sequence; identical to SEQ ID NO: 169981
  derived and/or modified sequence opt4 from neuraminidase__InfluenzaA__ADN89724

SEQ ID NO: 172506 - RNA, 1413 nt, Artificial Sequence; identical to SEQ ID NO: 169981
  derived and/or modified sequence opt4 from neuraminidase__InfluenzaA__ADN89735

SEQ ID NO: 172507 - RNA, 1413 nt, Artificial Sequence; identical to SEQ ID NO: 169981
  derived and/or modified sequence opt4 from neuraminidase__InfluenzaA__ADN89746

SEQ ID NO: 172508 - RNA, 1413 nt, Artificial Sequence; identical to SEQ ID NO: 169981
  derived and/or modified sequence opt4 from neuraminidase__InfluenzaA__ADN89757

SEQ ID NO: 172509 - RNA, 1413 nt, Artificial Sequence; identical to SEQ ID NO: 169981
  derived and/or modified sequence opt4 from neuraminidase__InfluenzaA__ADN89768

SEQ ID NO: 172510 - RNA, 1413 nt, Artificial Sequence; identical to SEQ ID NO: 172456
  derived and/or modified sequence opt4 from neuraminidase__InfluenzaA__ADN89779

SEQ ID NO: 172511 - RNA, 1413 nt, Artificial Sequence; identical to SEQ ID NO: 169981
  derived and/or modified sequence opt4 from neuraminidase__InfluenzaA__ADN89790

SEQ ID NO: 172512 - RNA, 1413 nt, Artificial Sequence
  derived and/or modified sequence opt4 from neuraminidase__InfluenzaA__ADN89801
augaaccccaaccagaagaucaucaccaucggcagcaucagcaucgccaucggcaccaucagccugaugcugcagaucggcaacaucaucagcaucugggccagccacagcauccagaccggcagccagaacaacaccggcaucugcaaccagagaaucaucaccuacaagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172513 - RNA, 1413 nt, Artificial Sequence
  derived and/or modified sequence opt4 from neuraminidase__InfluenzaA__ADN89823
augaaccccaaccagaagaucaucaccaucggcagcaucagcaucgccaucggcaucaucagccugaugcugcagaucggcagcaucaucagcaucugggccagccacagcauccacaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172514 - RNA, 1413 nt, Artificial Sequence; identical to SEQ ID NO: 171450
  derived and/or modified sequence opt4 from neuraminidase__InfluenzaA__ADN89834

SEQ ID NO: 172515 - RNA, 1413 nt, Artificial Sequence; identical to SEQ ID NO: 172452
  derived and/or modified sequence opt4 from neuraminidase__InfluenzaA__ADN89845

SEQ ID NO: 172516 - RNA, 1413 nt, Artificial Sequence; identical to SEQ ID NO: 169981
  derived and/or modified sequence opt4 from neuraminidase__InfluenzaA__ADN89856

SEQ ID NO: 172517 - RNA, 1410 nt, Artificial Sequence; identical to SEQ ID NO: 171930
  derived and/or modified sequence opt4 from neuraminidase__InfluenzaA__ADN89867

SEQ ID NO: 172518 - RNA, 1410 nt, Artificial Sequence; identical to SEQ ID NO: 171930
  derived and/or modified sequence opt4 from neuraminidase__InfluenzaA__ADN89878

SEQ ID NO: 172519 - RNA, 1410 nt, Artificial Sequence; identical to SEQ ID NO: 171930
  derived and/or modified sequence opt4 from neuraminidase__InfluenzaA__ADN89889

SEQ ID NO: 172520 - RNA, 1410 nt, Artificial Sequence; identical to SEQ ID NO: 171930
  derived and/or modified sequence opt4 from neuraminidase__InfluenzaA__ADN89900

SEQ ID NO: 172521 - RNA, 1410 nt, Artificial Sequence; identical to SEQ ID NO: 171930
  derived and/or modified sequence opt4 from neuraminidase__InfluenzaA__ADN89911

SEQ ID NO: 172522 - RNA, 1410 nt, Artificial Sequence
  derived and/or modified sequence opt4 from neuraminidase__InfluenzaA__ADN89922
augaaccccaaccagaagaucaucaccaucggcagcgugagccugaccaucagcaccaucugcuucuucaugcagaucgccauccugaucaccaccgugacccugcacuucaagcaguacaaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaacaucaugcccaucuga

SEQ ID NO: 172523 - RNA, 1410 nt, Artificial Sequence; identical to SEQ ID NO: 171930
  derived and/or modified sequence opt4 from neuraminidase__InfluenzaA__ADN89933

SEQ ID NO: 172524 - RNA, 1410 nt, Artificial Sequence; identical to SEQ ID NO: 171930
  derived and/or modified sequence opt4 from neuraminidase__InfluenzaA__ADN89955

SEQ ID NO: 172525 - RNA, 1410 nt, Artificial Sequence; identical to SEQ ID NO: 171930
  derived and/or modified sequence opt4 from neuraminidase__InfluenzaA__ADN89966

SEQ ID NO: 172526 - RNA, 1410 nt, Artificial Sequence; identical to SEQ ID NO: 171930
  derived and/or modified sequence opt4 from neuraminidase__InfluenzaA__ADN89977

SEQ ID NO: 172527 - RNA, 1410 nt, Artificial Sequence; identical to SEQ ID NO: 171930
  derived and/or modified sequence opt4 from neuraminidase__InfluenzaA__ADN89988

SEQ ID NO: 172528 - RNA, 1410 nt, Artificial Sequence; identical to SEQ ID NO: 171930
  derived and/or modified sequence opt4 from neuraminidase__InfluenzaA__ADN89999

SEQ ID NO: 172529 - RNA, 1410 nt, Artificial Sequence; identical to SEQ ID NO: 171930
  derived and/or modified sequence opt4 from neuraminidase__InfluenzaA__ADN90010

SEQ ID NO: 172530 - RNA, 1410 nt, Artificial Sequence; identical to SEQ ID NO: 171930
  derived and/or modified sequence opt4 from neuraminidase__InfluenzaA__ADN90021

SEQ ID NO: 172531 - RNA, 1410 nt, Artificial Sequence; identical to SEQ ID NO: 171930
  derived and/or modified sequence opt4 from neuraminidase__InfluenzaA__ADN90032

SEQ ID NO: 172532 - RNA, 1410 nt, Artificial Sequence; identical to SEQ ID NO: 171930
  derived and/or modified sequence opt4 from neuraminidase__InfluenzaA__ADN90043

SEQ ID NO: 172533 - RNA, 1410 nt, Artificial Sequence; identical to SEQ ID NO: 171930
  derived and/or modified sequence opt4 from neuraminidase__InfluenzaA__ADN90054

SEQ ID NO: 172534 - RNA, 1410 nt, Artificial Sequence; identical to SEQ ID NO: 171930
  derived and/or modified sequence opt4 from neuraminidase__InfluenzaA__ADN90065

SEQ ID NO: 172535 - RNA, 1410 nt, Artificial Sequence; identical to SEQ ID NO: 171930
  derived and/or modified sequence opt4 from neuraminidase__InfluenzaA__ADN90076

SEQ ID NO: 172536 - RNA, 1410 nt, Artificial Sequence; identical to SEQ ID NO: 171930
  derived and/or modified sequence opt4 from neuraminidase__InfluenzaA__ADN90087

SEQ ID NO: 172537 - RNA, 1410 nt, Artificial Sequence; identical to SEQ ID NO: 171930
  derived and/or modified sequence opt4 from neuraminidase__InfluenzaA__ADN90098

SEQ ID NO: 172538 - RNA, 1410 nt, Artificial Sequence; identical to SEQ ID NO: 171930
  derived and/or modified sequence opt4 from neuraminidase__InfluenzaA__ADN90109

SEQ ID NO: 172539 - RNA, 1410 nt, Artificial Sequence; identical to SEQ ID NO: 171930
  derived and/or modified sequence opt4 from neuraminidase__InfluenzaA__ADN90120

SEQ ID NO: 172540 - RNA, 1410 nt, Artificial Sequence; identical to SEQ ID NO: 171930
  derived and/or modified sequence opt4 from neuraminidase__InfluenzaA__ADN90131

SEQ ID NO: 172541 - RNA, 1410 nt, Artificial Sequence; identical to SEQ ID NO: 171930
  derived and/or modified sequence opt4 from neuraminidase__InfluenzaA__ADN90142

SEQ ID NO: 172542 - RNA, 1410 nt, Artificial Sequence; identical to SEQ ID NO: 171930
  derived and/or modified sequence opt4 from neuraminidase__InfluenzaA__ADN90153

SEQ ID NO: 172543 - RNA, 1410 nt, Artificial Sequence; identical to SEQ ID NO: 171930
  derived and/or modified sequence opt4 from neuraminidase__InfluenzaA__ADN90164

SEQ ID NO: 172544 - RNA, 1410 nt, Artificial Sequence; identical to SEQ ID NO: 171930
  derived and/or modified sequence opt4 from neuraminidase__InfluenzaA__ADN90186

SEQ ID NO: 172545 - RNA, 1410 nt, Artificial Sequence; identical to SEQ ID NO: 171930
  derived and/or modified sequence opt4 from neuraminidase__InfluenzaA__ADN90197

SEQ ID NO: 172546 - RNA, 1410 nt, Artificial Sequence
  derived and/or modified sequence opt4 from neuraminidase__InfluenzaA__ADN90208
augaaccccaaccagaagaucaucaccaucggcagcgugagccugaccaucagcaccaucugcuucuucaugcagaucgccauccugaucaccaccgugacccugcacuucaagcaguacaaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 172547 - RNA, 1410 nt, Artificial Sequence; identical to SEQ ID NO: 171930
  derived and/or modified sequence opt4 from neuraminidase__InfluenzaA__ADN90219

SEQ ID NO: 172548 - RNA, 1410 nt, Artificial Sequence
  derived and/or modified sequence opt4 from neuraminidase__InfluenzaA__ADN92469
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcgagaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172549 - RNA, 1410 nt, Artificial Sequence; identical to SEQ ID NO: 171775
  derived and/or modified sequence opt4 from neuraminidase__InfluenzaA__ADN92480

SEQ ID NO: 172550 - RNA, 1410 nt, Artificial Sequence; identical to SEQ ID NO: 171775
  derived and/or modified sequence opt4 from neuraminidase__InfluenzaA__ADN92491

SEQ ID NO: 172551 - RNA, 1410 nt, Artificial Sequence
  derived and/or modified sequence opt4 from neuraminidase__InfluenzaA__ADN92502
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggcaacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 172552 - RNA, 1410 nt, Artificial Sequence; identical to SEQ ID NO: 169258
  derived and/or modified sequence opt4 from neuraminidase__InfluenzaA__ADN92512

SEQ ID NO: 172553 - RNA, 1410 nt, Artificial Sequence; identical to SEQ ID NO: 169258
  derived and/or modified sequence opt4 from neuraminidase__InfluenzaA__ADN92522

SEQ ID NO: 172554 - RNA, 1410 nt, Artificial Sequence; identical to SEQ ID NO: 169258
  derived and/or modified sequence opt4 from neuraminidase__InfluenzaA__ADN92532

SEQ ID NO: 172555 - RNA, 1410 nt, Artificial Sequence; identical to SEQ ID NO: 169258
  derived and/or modified sequence opt4 from neuraminidase__InfluenzaA__ADN92542

SEQ ID NO: 172556 - RNA, 1410 nt, Artificial Sequence; identical to SEQ ID NO: 169258
  derived and/or modified sequence opt4 from neuraminidase__InfluenzaA__ADN92552

SEQ ID NO: 172557 - RNA, 1410 nt, Artificial Sequence; identical to SEQ ID NO: 169258
  derived and/or modified sequence opt4 from neuraminidase__InfluenzaA__ADO00733

SEQ ID NO: 172558 - RNA, 1410 nt, Artificial Sequence
  derived and/or modified sequence opt4 from neuraminidase__InfluenzaA__ADO00743
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgccaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucagacaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172559 - RNA, 1410 nt, Artificial Sequence; identical to SEQ ID NO: 170435
  derived and/or modified sequence opt4 from neuraminidase__InfluenzaA__ADO00753

SEQ ID NO: 172560 - RNA, 1410 nt, Artificial Sequence; identical to SEQ ID NO: 169258
  derived and/or modified sequence opt4 from neuraminidase__InfluenzaA__ADO12146

SEQ ID NO: 172561 - RNA, 1410 nt, Artificial Sequence; identical to SEQ ID NO: 169258
  derived and/or modified sequence opt4 from neuraminidase__InfluenzaA__ADO12156

SEQ ID NO: 172562 - RNA, 1410 nt, Artificial Sequence; identical to SEQ ID NO: 169258
  derived and/or modified sequence opt4 from neuraminidase__InfluenzaA__ADO12166

SEQ ID NO: 172563 - RNA, 1410 nt, Artificial Sequence; identical to SEQ ID NO: 169258
  derived and/or modified sequence opt4 from neuraminidase__InfluenzaA__ADO12176

SEQ ID NO: 172564 - RNA, 1410 nt, Artificial Sequence; identical to SEQ ID NO: 169258
  derived and/or modified sequence opt4 from neuraminidase__InfluenzaA__ADO12186

SEQ ID NO: 172565 - RNA, 1410 nt, Artificial Sequence; identical to SEQ ID NO: 169258
  derived and/or modified sequence opt4 from neuraminidase__InfluenzaA__ADO12196

SEQ ID NO: 172566 - RNA, 1410 nt, Artificial Sequence; identical to SEQ ID NO: 169258
  derived and/or modified sequence opt4 from neuraminidase__InfluenzaA__ADO12206

SEQ ID NO: 172567 - RNA, 1410 nt, Artificial Sequence; identical to SEQ ID NO: 169258
  derived and/or modified sequence opt4 from neuraminidase__InfluenzaA__ADO12216

SEQ ID NO: 172568 - RNA, 1410 nt, Artificial Sequence; identical to SEQ ID NO: 169258
  derived and/or modified sequence opt4 from neuraminidase__InfluenzaA__ADO12226

SEQ ID NO: 172569 - RNA, 1410 nt, Artificial Sequence; identical to SEQ ID NO: 169258
  derived and/or modified sequence opt4 from neuraminidase__InfluenzaA__ADO12246

SEQ ID NO: 172570 - RNA, 1410 nt, Artificial Sequence; identical to SEQ ID NO: 169258
  derived and/or modified sequence opt4 from neuraminidase__InfluenzaA__ADO12266

SEQ ID NO: 172571 - RNA, 1410 nt, Artificial Sequence
  derived and/or modified sequence opt4 from neuraminidase__InfluenzaA__ADO12276
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagagcggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172572 - RNA, 1410 nt, Artificial Sequence; identical to SEQ ID NO: 169258
  derived and/or modified sequence opt4 from neuraminidase__InfluenzaA__ADO12286

SEQ ID NO: 172573 - RNA, 1410 nt, Artificial Sequence; identical to SEQ ID NO: 169258
  derived and/or modified sequence opt4 from neuraminidase__InfluenzaA__ADO12296

SEQ ID NO: 172574 - RNA, 1410 nt, Artificial Sequence; identical to SEQ ID NO: 169258
  derived and/or modified sequence opt4 from neuraminidase__InfluenzaA__ADO12306

SEQ ID NO: 172575 - RNA, 1410 nt, Artificial Sequence
  derived and/or modified sequence opt4 from neuraminidase__InfluenzaA__ADO12316
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcgacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172576 - RNA, 1410 nt, Artificial Sequence; identical to SEQ ID NO: 169258
  derived and/or modified sequence opt4 from neuraminidase__InfluenzaA__ADO12326

SEQ ID NO: 172577 - RNA, 1410 nt, Artificial Sequence; identical to SEQ ID NO: 169258
  derived and/or modified sequence opt4 from neuraminidase__InfluenzaA__ADO12336

SEQ ID NO: 172578 - RNA, 1410 nt, Artificial Sequence; identical to SEQ ID NO: 169258
  derived and/or modified sequence opt4 from neuraminidase__InfluenzaA__ADO12346

SEQ ID NO: 172579 - RNA, 1410 nt, Artificial Sequence; identical to SEQ ID NO: 169258
  derived and/or modified sequence opt4 from neuraminidase__InfluenzaA__ADO12356

SEQ ID NO: 172580 - RNA, 1410 nt, Artificial Sequence; identical to SEQ ID NO: 169258
  derived and/or modified sequence opt4 from neuraminidase__InfluenzaA__ADO12366

SEQ ID NO: 172581 - RNA, 1410 nt, Artificial Sequence; identical to SEQ ID NO: 169258
  derived and/or modified sequence opt4 from neuraminidase__InfluenzaA__ADO12376

SEQ ID NO: 172582 - RNA, 1410 nt, Artificial Sequence; identical to SEQ ID NO: 169258
  derived and/or modified sequence opt4 from neuraminidase__InfluenzaA__ADO12386

SEQ ID NO: 172583 - RNA, 1410 nt, Artificial Sequence; identical to SEQ ID NO: 169258
  derived and/or modified sequence opt4 from neuraminidase__InfluenzaA__ADO12396

SEQ ID NO: 172584 - RNA, 1410 nt, Artificial Sequence; identical to SEQ ID NO: 169258
  derived and/or modified sequence opt4 from neuraminidase__InfluenzaA__ADO12406

SEQ ID NO: 172585 - RNA, 1410 nt, Artificial Sequence; identical to SEQ ID NO: 170025
  derived and/or modified sequence opt4 from neuraminidase__InfluenzaA__ADO12416

SEQ ID NO: 172586 - RNA, 1410 nt, Artificial Sequence; identical to SEQ ID NO: 169258
  derived and/or modified sequence opt4 from neuraminidase__InfluenzaA__ADO12426

SEQ ID NO: 172587 - RNA, 1410 nt, Artificial Sequence; identical to SEQ ID NO: 169258
  derived and/or modified sequence opt4 from neuraminidase__InfluenzaA__ADO12436

SEQ ID NO: 172588 - RNA, 1410 nt, Artificial Sequence; identical to SEQ ID NO: 169258
  derived and/or modified sequence opt4 from neuraminidase__InfluenzaA__ADO12446

SEQ ID NO: 172589 - RNA, 1410 nt, Artificial Sequence; identical to SEQ ID NO: 169258
  derived and/or modified sequence opt4 from neuraminidase__InfluenzaA__ADO12456

SEQ ID NO: 172590 - RNA, 1410 nt, Artificial Sequence; identical to SEQ ID NO: 169258
  derived and/or modified sequence opt4 from neuraminidase__InfluenzaA__ADO12466

SEQ ID NO: 172591 - RNA, 1410 nt, Artificial Sequence; identical to SEQ ID NO: 169258
  derived and/or modified sequence opt4 from neuraminidase__InfluenzaA__ADO12476

SEQ ID NO: 172592 - RNA, 1410 nt, Artificial Sequence; identical to SEQ ID NO: 169258
  derived and/or modified sequence opt4 from neuraminidase__InfluenzaA__ADO12486

SEQ ID NO: 172593 - RNA, 1410 nt, Artificial Sequence; identical to SEQ ID NO: 169258
  derived and/or modified sequence opt4 from neuraminidase__InfluenzaA__ADO12496

SEQ ID NO: 172594 - RNA, 1410 nt, Artificial Sequence; identical to SEQ ID NO: 169258
  derived and/or modified sequence opt4 from neuraminidase__InfluenzaA__ADO12506

SEQ ID NO: 172595 - RNA, 1410 nt, Artificial Sequence; identical to SEQ ID NO: 169258
  derived and/or modified sequence opt4 from neuraminidase__InfluenzaA__ADO12516

SEQ ID NO: 172596 - RNA, 1410 nt, Artificial Sequence; identical to SEQ ID NO: 169258
  derived and/or modified sequence opt4 from neuraminidase__InfluenzaA__ADO12526

SEQ ID NO: 172597 - RNA, 1410 nt, Artificial Sequence; identical to SEQ ID NO: 169258
  derived and/or modified sequence opt4 from neuraminidase__InfluenzaA__ADO12536

SEQ ID NO: 172598 - RNA, 1410 nt, Artificial Sequence; identical to SEQ ID NO: 169258
  derived and/or modified sequence opt4 from neuraminidase__InfluenzaA__ADO12546

SEQ ID NO: 172599 - RNA, 1410 nt, Artificial Sequence; identical to SEQ ID NO: 169258
  derived and/or modified sequence opt4 from neuraminidase__InfluenzaA__ADO12556

SEQ ID NO: 172600 - RNA, 1410 nt, Artificial Sequence; identical to SEQ ID NO: 169258
  derived and/or modified sequence opt4 from neuraminidase__InfluenzaA__ADO12566

SEQ ID NO: 172601 - RNA, 1410 nt, Artificial Sequence; identical to SEQ ID NO: 169258
  derived and/or modified sequence opt4 from neuraminidase__InfluenzaA__ADO12576

SEQ ID NO: 172602 - RNA, 1410 nt, Artificial Sequence
  derived and/or modified sequence opt4 from neuraminidase__InfluenzaA__ADO12586
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172603 - RNA, 1410 nt, Artificial Sequence; identical to SEQ ID NO: 172602
  derived and/or modified sequence opt4 from neuraminidase__InfluenzaA__ADO12596

SEQ ID NO: 172604 - RNA, 1410 nt, Artificial Sequence; identical to SEQ ID NO: 169258
  derived and/or modified sequence opt4 from neuraminidase__InfluenzaA__ADO12606

SEQ ID NO: 172605 - RNA, 1410 nt, Artificial Sequence; identical to SEQ ID NO: 169258
  derived and/or modified sequence opt4 from neuraminidase__InfluenzaA__ADO12616

SEQ ID NO: 172606 - RNA, 1410 nt, Artificial Sequence; identical to SEQ ID NO: 169258
  derived and/or modified sequence opt4 from neuraminidase__InfluenzaA__ADO12626

SEQ ID NO: 172607 - RNA, 1410 nt, Artificial Sequence; identical to SEQ ID NO: 169258
  derived and/or modified sequence opt4 from neuraminidase__InfluenzaA__ADO14355

SEQ ID NO: 172608 - RNA, 1401 nt, Artificial Sequence
  derived and/or modified sequence opt4 from neuraminidase__InfluenzaA__ADO21028
augaaccccaaccagaagaucaucgccaucggcagcgugagccugaccaucgccaccaucugcuuccugaugcagaucgccauccuggccaccaccaugacccugcacuucaagcagaacgagugcagcaaccccagcaacaaccagguggugcccugcgagcccaccaucaucgagagaaacaucgugcaccugaacagcaccaccaucgagaaggagaucugccccaagguggccgaguacaagaacuggagcaagccccagugccagaucaccggcagcgcccccuucagcaagggcaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagagugccccacagaacccugcugaugagcgagcugggcgugcccuuccaccugggcaccaagcaggugugcaucgccuggagcagcagcagcugccacgacggcaaggccuggcugcacgugugcgugaccggcgacgacaagaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagaaacgacgacagcuacagcagcagcaacugcagagaccccaacaacgagagaggcgcccccggcgugaagggcugggccuucgacaacggcaacgacaucuggaugggcagaaccaucaaggaggacagcagaagcggcuacgagaccuucagaguggugggcggcuggaccaccgccaacagcaagagccagaucaacagacaggugaucguggacagcgacaacuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugcccaucuga

SEQ ID NO: 172609 - RNA, 1401 nt, Artificial Sequence
  derived and/or modified sequence opt4 from neuraminidase__InfluenzaA__ADO21039
augaaccccaaccagaagaucaucgccaucggcagcgugagccugaccaucgccaccaucugcuuccugaugcagaucgccauccuggccaccaccaugacccugcacuucaagcagaacgagugcagcaaccccagcaacaaccagguggugcccugcgagcccaccaucaucgagagaaacaucgugcaccugaacagcaccaccaucgagaaggagaucugccccaagguggccgaguacaagaacuggagcaagccccagugccagaucaccggcagcgcccccuucagcaagggcaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagagacccccacagaacccugcugaugagcgagcugggcgugcccuuccaccugggcaccaagcaggugugcaucgccuggagcagcagcagcugccacgacggcaaggccuggcugcacgugugcgugaccggcgacgacaagaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguacaucaacauggccgacuacaccaucgagagcagcuacgugugcagcggccuggugggcgacacccccagaaacgacgacagcuacagcagcagcaacugcagagaccccaacaacgagagaggcgcccccggcgugaagggcugggccuucgacaacggcaacgacaucuggaugggcagaaccaucaaggaggacagcagaagcggcuacgagaccuucagaguggugggcggcuggaccaccgccaacagcaagagccagaucaacagacaggugaucguggacagcgacaacuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugcccaucuga

SEQ ID NO: 172610 - RNA, 1401 nt, Artificial Sequence
  derived and/or modified sequence opt4 from neuraminidase__InfluenzaA__ADO21050
augaaccccaaccagaagaucaucgccaucggcagcgugagccugaccaucgccaccaucugcuuccugaugcagaucgccauccuggccaccaccaugacccugcacuucaagcagaacgagugcagcaaccccagcaacaaccagguggugcccugcgagcccaccaucaucgagagaaacaucgugcaccugaacagcaccaccaucgagaaggagaucugccccaagguggccgaguacaagaacuggagcaagccccagugccagaucaccggcagcgcccccuucagcaagggcaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaggcccccacagaacccugcugaugagcgagcugggcgugcccuuccaccugggcaccaagcaggugugcaucgccuggagcagcagcagcugccacgacggcaaggccuggcugcacgugugcgugaccggcgacgacaagaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagaaacgacgacagcuacagcagcagcaacugcagagaccccaacaacgagagcggcgcccccggcgugaagggcugggccuucgacaacggcaacgacaucuggaugggcagaaccaucaaggaggacagcagaagcggcuacgagaccuucagaguggugggcggcuggaccaccgccaacagcaagagccagaucaacagacaggugaucguggacagcgacaacuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugcccaucuga

SEQ ID NO: 172611 - RNA, 1410 nt, Artificial Sequence
  derived and/or modified sequence opt4 from neuraminidase__InfluenzaA__ADO25095
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaagcggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172612 - RNA, 1410 nt, Artificial Sequence
  derived and/or modified sequence opt4 from neuraminidase__InfluenzaA__ADO25105
augaaccccaaccagaagaucaucaccaucggcagcgugugcaugaccaucggcauggccaaccugauccugcagaucggcaacaucaucagcaucuggaucagccacagcauccagcugggcaaccagaaccagaucggcaccugcaaccagagcgugaucaccuacgagaccaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacagacaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172613 - RNA, 1410 nt, Artificial Sequence; identical to SEQ ID NO: 171039
  derived and/or modified sequence opt4 from neuraminidase__InfluenzaA__ADO25115

SEQ ID NO: 172614 - RNA, 1410 nt, Artificial Sequence; identical to SEQ ID NO: 171039
  derived and/or modified sequence opt4 from neuraminidase__InfluenzaA__ADO25125

SEQ ID NO: 172615 - RNA, 1410 nt, Artificial Sequence
  derived and/or modified sequence opt4 from neuraminidase__InfluenzaA__ADO25135
augaaccccaaccagaagaucaucaccaucggcagcgugugcaugaccaucggcauggccaaccuggugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172616 - RNA, 1410 nt, Artificial Sequence; identical to SEQ ID NO: 170609
  derived and/or modified sequence opt4 from neuraminidase__InfluenzaA__ADO25145

SEQ ID NO: 172617 - RNA, 1410 nt, Artificial Sequence; identical to SEQ ID NO: 169258
  derived and/or modified sequence opt4 from neuraminidase__InfluenzaA__ADO25155

SEQ ID NO: 172618 - RNA, 1410 nt, Artificial Sequence; identical to SEQ ID NO: 169258
  derived and/or modified sequence opt4 from neuraminidase__InfluenzaA__ADO25165

SEQ ID NO: 172619 - RNA, 1410 nt, Artificial Sequence; identical to SEQ ID NO: 169258
  derived and/or modified sequence opt4 from neuraminidase__InfluenzaA__ADO25175

SEQ ID NO: 172620 - RNA, 1410 nt, Artificial Sequence
  derived and/or modified sequence opt4 from neuraminidase__InfluenzaA__ADO25185
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaugagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172621 - RNA, 1410 nt, Artificial Sequence; identical to SEQ ID NO: 171687
  derived and/or modified sequence opt4 from neuraminidase__InfluenzaA__ADO25195

SEQ ID NO: 172622 - RNA, 1410 nt, Artificial Sequence; identical to SEQ ID NO: 170395
  derived and/or modified sequence opt4 from neuraminidase__InfluenzaA__ADO25205

SEQ ID NO: 172623 - RNA, 1410 nt, Artificial Sequence; identical to SEQ ID NO: 170609
  derived and/or modified sequence opt4 from neuraminidase__InfluenzaA__ADO25215

SEQ ID NO: 172624 - RNA, 1410 nt, Artificial Sequence; identical to SEQ ID NO: 169258
  derived and/or modified sequence opt4 from neuraminidase__InfluenzaA__ADO25225

SEQ ID NO: 172625 - RNA, 1410 nt, Artificial Sequence; identical to SEQ ID NO: 170609
  derived and/or modified sequence opt4 from neuraminidase__InfluenzaA__ADO25235

SEQ ID NO: 172626 - RNA, 1410 nt, Artificial Sequence; identical to SEQ ID NO: 169258
  derived and/or modified sequence opt4 from neuraminidase__InfluenzaA__ADO25245

SEQ ID NO: 172627 - RNA, 1410 nt, Artificial Sequence; identical to SEQ ID NO: 169258
  derived and/or modified sequence opt4 from neuraminidase__InfluenzaA__ADO25255

SEQ ID NO: 172628 - RNA, 1410 nt, Artificial Sequence; identical to SEQ ID NO: 171039
  derived and/or modified sequence opt4 from neuraminidase__InfluenzaA__ADO25265

SEQ ID NO: 172629 - RNA, 1410 nt, Artificial Sequence; identical to SEQ ID NO: 170850
  derived and/or modified sequence opt4 from neuraminidase__InfluenzaA__ADO25275

SEQ ID NO: 172630 - RNA, 1410 nt, Artificial Sequence; identical to SEQ ID NO: 170609
  derived and/or modified sequence opt4 from neuraminidase__InfluenzaA__ADO25285

SEQ ID NO: 172631 - RNA, 1413 nt, Artificial Sequence
  derived and/or modified sequence opt4 from neuraminidase__InfluenzaA__ADO27623
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacguggccgccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172632 - RNA, 1410 nt, Artificial Sequence; identical to SEQ ID NO: 169258
  derived and/or modified sequence opt4 from neuraminidase__InfluenzaA__ADO30410

SEQ ID NO: 172633 - RNA, 1410 nt, Artificial Sequence; identical to SEQ ID NO: 170609
  derived and/or modified sequence opt4 from neuraminidase__InfluenzaA__ADO30420

SEQ ID NO: 172634 - RNA, 1410 nt, Artificial Sequence; identical to SEQ ID NO: 169966
  derived and/or modified sequence opt4 from neuraminidase__InfluenzaA__ADP95343

SEQ ID NO: 172635 - RNA, 1410 nt, Artificial Sequence; identical to SEQ ID NO: 169248
  derived and/or modified sequence opt4 from neuraminidase__InfluenzaA__ADP95353

SEQ ID NO: 172636 - RNA, 1410 nt, Artificial Sequence; identical to SEQ ID NO: 169248
  derived and/or modified sequence opt4 from neuraminidase__InfluenzaA__ADP95363

SEQ ID NO: 172637 - RNA, 1410 nt, Artificial Sequence; identical to SEQ ID NO: 169248
  derived and/or modified sequence opt4 from neuraminidase__InfluenzaA__ADP95373

SEQ ID NO: 172638 - RNA, 1410 nt, Artificial Sequence; identical to SEQ ID NO: 169248
  derived and/or modified sequence opt4 from neuraminidase__InfluenzaA__ADP95383

SEQ ID NO: 172639 - RNA, 1410 nt, Artificial Sequence; identical to SEQ ID NO: 169248
  derived and/or modified sequence opt4 from neuraminidase__InfluenzaA__ADP95393

SEQ ID NO: 172640 - RNA, 1410 nt, Artificial Sequence
  derived and/or modified sequence opt4 from neuraminidase__InfluenzaA__ADQ43774
augaaccccaaccagaagaucaucaccaucggcagcggcugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172641 - RNA, 1410 nt, Artificial Sequence
  derived and/or modified sequence opt4 from neuraminidase__InfluenzaA__ADQ92578
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugauccugugcgagcccaccaucaucgagagaaacaucaccgagaucguguaccugaccaacgccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172642 - RNA, 1410 nt, Artificial Sequence; identical to SEQ ID NO: 169119
  derived and/or modified sequence opt4 from neuraminidase__InfluenzaA__ADR32364

SEQ ID NO: 172643 - RNA, 1410 nt, Artificial Sequence
  derived and/or modified sequence opt4 from neuraminidase__InfluenzaA__ADT64478
augaaccccaaccagaagaucaucaccaucggcagcgugugcaugaccaucggcauggccaaccugauccugcagaucggcaacaucaucagcaucuggaucggccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172644 - RNA, 1410 nt, Artificial Sequence
  derived and/or modified sequence opt4 from neuraminidase__InfluenzaA__ADT78889
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucagcuucaugcccaucuga

SEQ ID NO: 172645 - RNA, 1410 nt, Artificial Sequence
  derived and/or modified sequence opt4 from neuraminidase__InfluenzaA__ADT78899
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaugagagagcccuacgugagcugcaaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcagcagcaucgugguguucugcggcaccagcggcaccuacggcaccggcagcuggcccgacggcgccaacaucaacuucaugcccaucuga

SEQ ID NO: 172646 - RNA, 1410 nt, Artificial Sequence
  derived and/or modified sequence opt4 from neuraminidase__InfluenzaA__ADT78963
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagagaccccaacaacgagagaggcaaccccggcgugaagggcugggccuucgacaacggcaacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 172647 - RNA, 1410 nt, Artificial Sequence
  derived and/or modified sequence opt4 from neuraminidase__InfluenzaA__ADT79001
augaaccccaaccagaagaucaucaccaucggcagcaucagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcaaggccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagagaggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 172648 - RNA, 1410 nt, Artificial Sequence; identical to SEQ ID NO: 166638
  derived and/or modified sequence opt4 from neuraminidase__InfluenzaA__ADT79021

SEQ ID NO: 172649 - RNA, 1410 nt, Artificial Sequence
  derived and/or modified sequence opt4 from neuraminidase__InfluenzaA__ADT79041
augaaccccaaccagaagaucaucaccaucggcagcgugagccugaccaucgccaccgugugcuuccugaugcagaucgccauccuggugaccaccgugacccugcacuucagacaguacgagugcgacagccccgccaacaaccaggugaugcccugcgagcccaucaucaucgagagaaacaucaccgagaucguguaccugaacaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacguggaggacuacagcaucgacagcagcuacgugugcagcggccuggugggcgacacccccagaaacaacgacagaagcagcaacagcaacugcagaaaccccaacaacgagagaggcaaccacggcgugaagggcugggccuucgacgacggcaacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 172650 - RNA, 1410 nt, Artificial Sequence; identical to SEQ ID NO: 168280
  derived and/or modified sequence opt4 from neuraminidase__InfluenzaA__ADT79121

SEQ ID NO: 172651 - RNA, 1410 nt, Artificial Sequence
  derived and/or modified sequence opt4 from neuraminidase__InfluenzaA__ADT79131
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacuggaggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugcuggacaucagcauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaagccaggagaccagagugugguggaccagcaacagcaucgugguguucugcggcaccagcggcaccuacggcaccggcagcuggcccgacggcgccaacaucaacuucaugcccaucuga

SEQ ID NO: 172652 - RNA, 1410 nt, Artificial Sequence; identical to SEQ ID NO: 169258
  derived and/or modified sequence opt4 from neuraminidase__InfluenzaA__ADT79234

SEQ ID NO: 172653 - RNA, 1410 nt, Artificial Sequence; identical to SEQ ID NO: 169248
  derived and/or modified sequence opt4 from neuraminidase__InfluenzaA__ADT79244

SEQ ID NO: 172654 - RNA, 1410 nt, Artificial Sequence
  derived and/or modified sequence opt4 from neuraminidase__InfluenzaA__ADU25480
augaaccccaaccagaagaucaucaucaucagcagcaucugccugaucaacggcaucaccagccugauccugcagaucggcaacaucaucagcaucuggaucagccacagcauccagaucggcaaccagaaccagaccgagaccugcagccagaacaucaucaccuacgagaacaacaccugggugaaccagaccuacgugaacaucagcaacaacaacuucguggccgagcaggccguggugagcaugaagcuggccggcagcagcccccugugccccgugagcggcugggccaucuacagcaaggacaacagcgugagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaccagcuggcugaccaucggcaucagcggccccgacaacggcgccguggccgugcugaaguacaacgacaucaucaccgacaccaucaagagcuggagaaacaacauccugagaacccaggagagcgagugcgugugcgugaacggcagcugcuucaccgugaugaccgacggccccagcaacggccaggccagcuacaagaucuucaagaucgagaagggcaagguggugaagagcguggagcugaacgcccccaacuaccacuacgaggagugcagcugcuaccccgacagcggcgagaucaucugcgugugcagagacaacuggcacggcagcaacagacccugggugagcuucaaccagaaccuggaguaccagaucggcuacaucugcagcggcauccugggcgacaaccccagacccaacgacagaaccggcagcugcggccccgugagccugaacggcgccaacggcgugaagggcuucagcuucaaguacggcaacggcguguggaucggcagaaccaagagcagcagcagcagaagcggcuucgagaugaucugggaccccaacggcuggaccgagaccgacaacaacuuccuggugaagcaggacaucgugggcaugaccgacuggagcggcuacagcggcagcuucgugcagcaccccgagcugaccggcaugaacugcaugagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 172655 - RNA, 1410 nt, Artificial Sequence; identical to SEQ ID NO: 169258
  derived and/or modified sequence opt4 from neuraminidase__InfluenzaA__ADU59780

SEQ ID NO: 172656 - RNA, 1410 nt, Artificial Sequence
  derived and/or modified sequence opt4 from neuraminidase__InfluenzaA__ADU59789
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacgugagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172657 - RNA, 1410 nt, Artificial Sequence; identical to SEQ ID NO: 169258
  derived and/or modified sequence opt4 from neuraminidase__InfluenzaA__ADU59829

SEQ ID NO: 172658 - RNA, 1410 nt, Artificial Sequence
  derived and/or modified sequence opt4 from neuraminidase__InfluenzaA__ADU59838
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuucgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 172659 - RNA, 1410 nt, Artificial Sequence; identical to SEQ ID NO: 170609
  derived and/or modified sequence opt4 from neuraminidase__InfluenzaA__ADU59847

SEQ ID NO: 172660 - RNA, 1410 nt, Artificial Sequence; identical to SEQ ID NO: 169258
  derived and/or modified sequence opt4 from neuraminidase__InfluenzaA__ADU59907

SEQ ID NO: 172661 - RNA, 1410 nt, Artificial Sequence; identical to SEQ ID NO: 169258
  derived and/or modified sequence opt4 from neuraminidase__InfluenzaA__ADU59917

SEQ ID NO: 172662 - RNA, 1410 nt, Artificial Sequence; identical to SEQ ID NO: 169258
  derived and/or modified sequence opt4 from neuraminidase__InfluenzaA__ADU59920

SEQ ID NO: 172663 - RNA, 1410 nt, Artificial Sequence; identical to SEQ ID NO: 169258
  derived and/or modified sequence opt4 from neuraminidase__InfluenzaA__ADU59941

SEQ ID NO: 172664 - RNA, 1410 nt, Artificial Sequence
  derived and/or modified sequence opt4 from neuraminidase__InfluenzaA__ADU76311
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccaagcugcccuucaccaucgacaaguga

SEQ ID NO: 172665 - RNA, 1410 nt, Artificial Sequence
  derived and/or modified sequence opt4 from neuraminidase__InfluenzaA__ADU76313
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccaagcugcccuucaccaucgacaaguga

SEQ ID NO: 172666 - RNA, 1410 nt, Artificial Sequence; identical to SEQ ID NO: 172665
  derived and/or modified sequence opt4 from neuraminidase__InfluenzaA__ADU76314

SEQ ID NO: 172667 - RNA, 1410 nt, Artificial Sequence; identical to SEQ ID NO: 172665
  derived and/or modified sequence opt4 from neuraminidase__InfluenzaA__ADU76315

SEQ ID NO: 172668 - RNA, 1410 nt, Artificial Sequence; identical to SEQ ID NO: 172665
  derived and/or modified sequence opt4 from neuraminidase__InfluenzaA__ADU76316

SEQ ID NO: 172669 - RNA, 1410 nt, Artificial Sequence
  derived and/or modified sequence opt4 from neuraminidase__InfluenzaA__ADU76317
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaccagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172670 - RNA, 1410 nt, Artificial Sequence
  derived and/or modified sequence opt4 from neuraminidase__InfluenzaA__ADU76318
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccacaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172671 - RNA, 1410 nt, Artificial Sequence; identical to SEQ ID NO: 170501
  derived and/or modified sequence opt4 from neuraminidase__InfluenzaA__ADU76319

SEQ ID NO: 172672 - RNA, 1410 nt, Artificial Sequence; identical to SEQ ID NO: 169258
  derived and/or modified sequence opt4 from neuraminidase__InfluenzaA__ADU76320

SEQ ID NO: 172673 - RNA, 1410 nt, Artificial Sequence; identical to SEQ ID NO: 169258
  derived and/or modified sequence opt4 from neuraminidase__InfluenzaA__ADU76321

SEQ ID NO: 172674 - RNA, 1410 nt, Artificial Sequence
  derived and/or modified sequence opt4 from neuraminidase__InfluenzaA__ADU76322
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagguggugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 172675 - RNA, 1410 nt, Artificial Sequence; identical to SEQ ID NO: 172664
  derived and/or modified sequence opt4 from neuraminidase__InfluenzaA__ADU76323

SEQ ID NO: 172676 - RNA, 1410 nt, Artificial Sequence; identical to SEQ ID NO: 172665
  derived and/or modified sequence opt4 from neuraminidase__InfluenzaA__ADU76324

SEQ ID NO: 172677 - RNA, 1410 nt, Artificial Sequence; identical to SEQ ID NO: 172664
  derived and/or modified sequence opt4 from neuraminidase__InfluenzaA__ADU76325

SEQ ID NO: 172678 - RNA, 1410 nt, Artificial Sequence; identical to SEQ ID NO: 172665
  derived and/or modified sequence opt4 from neuraminidase__InfluenzaA__ADU76326

SEQ ID NO: 172679 - RNA, 1410 nt, Artificial Sequence; identical to SEQ ID NO: 172665
  derived and/or modified sequence opt4 from neuraminidase__InfluenzaA__ADU76327

SEQ ID NO: 172680 - RNA, 1410 nt, Artificial Sequence; identical to SEQ ID NO: 172664
  derived and/or modified sequence opt4 from neuraminidase__InfluenzaA__ADU76328

SEQ ID NO: 172681 - RNA, 1410 nt, Artificial Sequence; identical to SEQ ID NO: 172665
  derived and/or modified sequence opt4 from neuraminidase__InfluenzaA__ADU76329

SEQ ID NO: 172682 - RNA, 1410 nt, Artificial Sequence; identical to SEQ ID NO: 172665
  derived and/or modified sequence opt4 from neuraminidase__InfluenzaA__ADU76330

SEQ ID NO: 172683 - RNA, 1410 nt, Artificial Sequence; identical to SEQ ID NO: 172665
  derived and/or modified sequence opt4 from neuraminidase__InfluenzaA__ADU76331

SEQ ID NO: 172684 - RNA, 1410 nt, Artificial Sequence; identical to SEQ ID NO: 172665
  derived and/or modified sequence opt4 from neuraminidase__InfluenzaA__ADU76332

SEQ ID NO: 172685 - RNA, 1410 nt, Artificial Sequence; identical to SEQ ID NO: 169258
  derived and/or modified sequence opt4 from neuraminidase__InfluenzaA__ADU76333

SEQ ID NO: 172686 - RNA, 1410 nt, Artificial Sequence; identical to SEQ ID NO: 169258
  derived and/or modified sequence opt4 from neuraminidase__InfluenzaA__ADU76334

SEQ ID NO: 172687 - RNA, 1410 nt, Artificial Sequence; identical to SEQ ID NO: 169258
  derived and/or modified sequence opt4 from neuraminidase__InfluenzaA__ADU76335

SEQ ID NO: 172688 - RNA, 1410 nt, Artificial Sequence; identical to SEQ ID NO: 172665
  derived and/or modified sequence opt4 from neuraminidase__InfluenzaA__ADU76336

SEQ ID NO: 172689 - RNA, 1410 nt, Artificial Sequence; identical to SEQ ID NO: 170025
  derived and/or modified sequence opt4 from neuraminidase__InfluenzaA__ADU76337

SEQ ID NO: 172690 - RNA, 1410 nt, Artificial Sequence; identical to SEQ ID NO: 171160
  derived and/or modified sequence opt4 from neuraminidase__InfluenzaA__ADU76338

SEQ ID NO: 172691 - RNA, 1410 nt, Artificial Sequence; identical to SEQ ID NO: 172664
  derived and/or modified sequence opt4 from neuraminidase__InfluenzaA__ADU76339

SEQ ID NO: 172692 - RNA, 1410 nt, Artificial Sequence; identical to SEQ ID NO: 169258
  derived and/or modified sequence opt4 from neuraminidase__InfluenzaA__ADU76341

SEQ ID NO: 172693 - RNA, 1410 nt, Artificial Sequence; identical to SEQ ID NO: 169258
  derived and/or modified sequence opt4 from neuraminidase__InfluenzaA__ADU76342

SEQ ID NO: 172694 - RNA, 1410 nt, Artificial Sequence; identical to SEQ ID NO: 169258
  derived and/or modified sequence opt4 from neuraminidase__InfluenzaA__ADU76343

SEQ ID NO: 172695 - RNA, 1410 nt, Artificial Sequence; identical to SEQ ID NO: 172665
  derived and/or modified sequence opt4 from neuraminidase__InfluenzaA__ADU76344

SEQ ID NO: 172696 - RNA, 1410 nt, Artificial Sequence; identical to SEQ ID NO: 172665
  derived and/or modified sequence opt4 from neuraminidase__InfluenzaA__ADU76345

SEQ ID NO: 172697 - RNA, 1410 nt, Artificial Sequence
  derived and/or modified sequence opt4 from neuraminidase__InfluenzaA__ADU76346
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172698 - RNA, 1410 nt, Artificial Sequence; identical to SEQ ID NO: 170025
  derived and/or modified sequence opt4 from neuraminidase__InfluenzaA__ADU76347

SEQ ID NO: 172699 - RNA, 1410 nt, Artificial Sequence
  derived and/or modified sequence opt4 from neuraminidase__InfluenzaA__ADV17285
augaaccccaaccaggagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucagauacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172700 - RNA, 1410 nt, Artificial Sequence; identical to SEQ ID NO: 169258
  derived and/or modified sequence opt4 from neuraminidase__InfluenzaA__ADV17295

SEQ ID NO: 172701 - RNA, 1410 nt, Artificial Sequence
  derived and/or modified sequence opt4 from neuraminidase__InfluenzaA__ADV17305
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcagccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggcagcgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172702 - RNA, 1410 nt, Artificial Sequence; identical to SEQ ID NO: 169258
  derived and/or modified sequence opt4 from neuraminidase__InfluenzaA__ADV17315

SEQ ID NO: 172703 - RNA, 1410 nt, Artificial Sequence; identical to SEQ ID NO: 170689
  derived and/or modified sequence opt4 from neuraminidase__InfluenzaA__ADV17325

SEQ ID NO: 172704 - RNA, 1410 nt, Artificial Sequence
  derived and/or modified sequence opt4 from neuraminidase__InfluenzaA__ADV17335
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagugccccuucaccaucgacaaguga

SEQ ID NO: 172705 - RNA, 1410 nt, Artificial Sequence; identical to SEQ ID NO: 169258
  derived and/or modified sequence opt4 from neuraminidase__InfluenzaA__ADV19022

SEQ ID NO: 172706 - RNA, 1410 nt, Artificial Sequence
  derived and/or modified sequence opt4 from neuraminidase__InfluenzaA__ADV41679
augaaccccaaccagaagaucaucaccaucggcagcgugugcaugaccaucggcauggccaaccugauccugcagaucggcaacaucaucagcaucuggaucagccacagcauccagcugagaaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172707 - RNA, 1410 nt, Artificial Sequence
  derived and/or modified sequence opt4 from neuraminidase__InfluenzaA__ADV76582
augaaccccaaccagaagaucaucaccaucggcagcgugagccugaccaucagcaccgugugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 172708 - RNA, 1410 nt, Artificial Sequence; identical to SEQ ID NO: 169119
  derived and/or modified sequence opt4 from neuraminidase__InfluenzaA__ADV76590

SEQ ID NO: 172709 - RNA, 1410 nt, Artificial Sequence; identical to SEQ ID NO: 169119
  derived and/or modified sequence opt4 from neuraminidase__InfluenzaA__ADV76601

SEQ ID NO: 172710 - RNA, 1410 nt, Artificial Sequence; identical to SEQ ID NO: 170112
  derived and/or modified sequence opt4 from neuraminidase__InfluenzaA__ADV76612

SEQ ID NO: 172711 - RNA, 1410 nt, Artificial Sequence; identical to SEQ ID NO: 169119
  derived and/or modified sequence opt4 from neuraminidase__InfluenzaA__ADV76623

SEQ ID NO: 172712 - RNA, 1410 nt, Artificial Sequence; identical to SEQ ID NO: 169119
  derived and/or modified sequence opt4 from neuraminidase__InfluenzaA__ADV76634

SEQ ID NO: 172713 - RNA, 1410 nt, Artificial Sequence; identical to SEQ ID NO: 171986
  derived and/or modified sequence opt4 from neuraminidase__InfluenzaA__ADV76645

SEQ ID NO: 172714 - RNA, 1410 nt, Artificial Sequence
  derived and/or modified sequence opt4 from neuraminidase__InfluenzaA__ADV76667
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaagagcagaaaccccaacaacgagagaggcaaccagggcgugaagggcugggccuucgacaacggcgacgacguguggaugggcagaaccaucagcagagaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 172715 - RNA, 1410 nt, Artificial Sequence; identical to SEQ ID NO: 171988
  derived and/or modified sequence opt4 from neuraminidase__InfluenzaA__ADV76676

SEQ ID NO: 172716 - RNA, 1410 nt, Artificial Sequence; identical to SEQ ID NO: 171129
  derived and/or modified sequence opt4 from neuraminidase__InfluenzaA__ADV76697

SEQ ID NO: 172717 - RNA, 1410 nt, Artificial Sequence
  derived and/or modified sequence opt4 from neuraminidase__InfluenzaA__ADV76708
augaaccccaaccagaagaucaucaccaucggcagcgugagccugaccaucagcaccaucugcuucuucaugcagaccgccauccugaucaccaccgugacccugcacuucaagcagugcgaguucaacagcccccccaacaaccaggugaugcugugcgagcccaccaucaucgagagaaacaucaccgagaucguguaccugaccaacaucaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172718 - RNA, 1410 nt, Artificial Sequence
  derived and/or modified sequence opt4 from neuraminidase__InfluenzaA__ADV76719
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagaagaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaugaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172719 - RNA, 1410 nt, Artificial Sequence
  derived and/or modified sequence opt4 from neuraminidase__InfluenzaA__ADV76730
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagacccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaaggacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172720 - RNA, 1410 nt, Artificial Sequence
  derived and/or modified sequence opt4 from neuraminidase__InfluenzaA__ADV78132
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccuggcugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccccagcgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcgugggcaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucugggccagcggcagcagcaucagcuucugcggcgugaacagcgacaccgugggcuggagcuggcccgacggcgccgagcugcccuucaucaucgacaaguga

SEQ ID NO: 172721 - RNA, 1413 nt, Artificial Sequence
  derived and/or modified sequence opt4 from neuraminidase__InfluenzaA__ADW09104
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccaacaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172722 - RNA, 1413 nt, Artificial Sequence; identical to SEQ ID NO: 169981
  derived and/or modified sequence opt4 from neuraminidase__InfluenzaA__ADW09114

SEQ ID NO: 172723 - RNA, 1413 nt, Artificial Sequence
  derived and/or modified sequence opt4 from neuraminidase__InfluenzaA__ADW09123
augaaccccaaccagaagaucaucaccaucggcagcaucagcaucgccaucggcaucaccagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172724 - RNA, 1413 nt, Artificial Sequence
  derived and/or modified sequence opt4 from neuraminidase__InfluenzaA__ADW09156
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172725 - RNA, 1413 nt, Artificial Sequence
  derived and/or modified sequence opt4 from neuraminidase__InfluenzaA__ADW09167
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccgugaacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172726 - RNA, 1413 nt, Artificial Sequence; identical to SEQ ID NO: 169981
  derived and/or modified sequence opt4 from neuraminidase__InfluenzaA__ADW09178

SEQ ID NO: 172727 - RNA, 1413 nt, Artificial Sequence; identical to SEQ ID NO: 169981
  derived and/or modified sequence opt4 from neuraminidase__InfluenzaA__ADW09189

SEQ ID NO: 172728 - RNA, 1413 nt, Artificial Sequence; identical to SEQ ID NO: 172725
  derived and/or modified sequence opt4 from neuraminidase__InfluenzaA__ADW09211

SEQ ID NO: 172729 - RNA, 1413 nt, Artificial Sequence
  derived and/or modified sequence opt4 from neuraminidase__InfluenzaA__ADW09222
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaacagcgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172730 - RNA, 1413 nt, Artificial Sequence
  derived and/or modified sequence opt4 from neuraminidase__InfluenzaA__ADW09233
augaaccccaaccagaagaucaucaccaucggcagcaucagcaucgccaucggcaccaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172731 - RNA, 1413 nt, Artificial Sequence; identical to SEQ ID NO: 172724
  derived and/or modified sequence opt4 from neuraminidase__InfluenzaA__ADW09244

SEQ ID NO: 172732 - RNA, 1413 nt, Artificial Sequence; identical to SEQ ID NO: 172724
  derived and/or modified sequence opt4 from neuraminidase__InfluenzaA__ADW09255

SEQ ID NO: 172733 - RNA, 1413 nt, Artificial Sequence; identical to SEQ ID NO: 172724
  derived and/or modified sequence opt4 from neuraminidase__InfluenzaA__ADW09266

SEQ ID NO: 172734 - RNA, 1413 nt, Artificial Sequence; identical to SEQ ID NO: 172724
  derived and/or modified sequence opt4 from neuraminidase__InfluenzaA__ADW09277

SEQ ID NO: 172735 - RNA, 1413 nt, Artificial Sequence; identical to SEQ ID NO: 169981
  derived and/or modified sequence opt4 from neuraminidase__InfluenzaA__ADW09288

SEQ ID NO: 172736 - RNA, 1413 nt, Artificial Sequence; identical to SEQ ID NO: 172725
  derived and/or modified sequence opt4 from neuraminidase__InfluenzaA__ADW09299

SEQ ID NO: 172737 - RNA, 1413 nt, Artificial Sequence; identical to SEQ ID NO: 169981
  derived and/or modified sequence opt4 from neuraminidase__InfluenzaA__ADW09310

SEQ ID NO: 172738 - RNA, 1413 nt, Artificial Sequence; identical to SEQ ID NO: 169981
  derived and/or modified sequence opt4 from neuraminidase__InfluenzaA__ADW09330

SEQ ID NO: 172739 - RNA, 1413 nt, Artificial Sequence; identical to SEQ ID NO: 172724
  derived and/or modified sequence opt4 from neuraminidase__InfluenzaA__ADW10475

SEQ ID NO: 172740 - RNA, 1413 nt, Artificial Sequence; identical to SEQ ID NO: 172725
  derived and/or modified sequence opt4 from neuraminidase__InfluenzaA__ADW10486

SEQ ID NO: 172741 - RNA, 1413 nt, Artificial Sequence; identical to SEQ ID NO: 169981
  derived and/or modified sequence opt4 from neuraminidase__InfluenzaA__ADW10497

SEQ ID NO: 172742 - RNA, 1413 nt, Artificial Sequence
  derived and/or modified sequence opt4 from neuraminidase__InfluenzaA__ADW10508
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccuggugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccgugaacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172743 - RNA, 1413 nt, Artificial Sequence; identical to SEQ ID NO: 169981
  derived and/or modified sequence opt4 from neuraminidase__InfluenzaA__ADW10519

SEQ ID NO: 172744 - RNA, 1413 nt, Artificial Sequence; identical to SEQ ID NO: 169981
  derived and/or modified sequence opt4 from neuraminidase__InfluenzaA__ADW10530

SEQ ID NO: 172745 - RNA, 1413 nt, Artificial Sequence
  derived and/or modified sequence opt4 from neuraminidase__InfluenzaA__ADW10541
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcauggacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172746 - RNA, 1413 nt, Artificial Sequence
  derived and/or modified sequence opt4 from neuraminidase__InfluenzaA__ADW10552
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccgacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccgugaacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172747 - RNA, 1413 nt, Artificial Sequence; identical to SEQ ID NO: 172457
  derived and/or modified sequence opt4 from neuraminidase__InfluenzaA__ADW10563

SEQ ID NO: 172748 - RNA, 1413 nt, Artificial Sequence; identical to SEQ ID NO: 169981
  derived and/or modified sequence opt4 from neuraminidase__InfluenzaA__ADW10574

SEQ ID NO: 172749 - RNA, 1413 nt, Artificial Sequence
  derived and/or modified sequence opt4 from neuraminidase__InfluenzaA__ADW10585
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaagagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggaguaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172750 - RNA, 1413 nt, Artificial Sequence; identical to SEQ ID NO: 172725
  derived and/or modified sequence opt4 from neuraminidase__InfluenzaA__ADW10596

SEQ ID NO: 172751 - RNA, 1413 nt, Artificial Sequence; identical to SEQ ID NO: 172724
  derived and/or modified sequence opt4 from neuraminidase__InfluenzaA__ADW10607

SEQ ID NO: 172752 - RNA, 1413 nt, Artificial Sequence; identical to SEQ ID NO: 172724
  derived and/or modified sequence opt4 from neuraminidase__InfluenzaA__ADW10618

SEQ ID NO: 172753 - RNA, 1413 nt, Artificial Sequence; identical to SEQ ID NO: 172724
  derived and/or modified sequence opt4 from neuraminidase__InfluenzaA__ADW10629

SEQ ID NO: 172754 - RNA, 1413 nt, Artificial Sequence; identical to SEQ ID NO: 172724
  derived and/or modified sequence opt4 from neuraminidase__InfluenzaA__ADW10724

SEQ ID NO: 172755 - RNA, 1413 nt, Artificial Sequence; identical to SEQ ID NO: 172725
  derived and/or modified sequence opt4 from neuraminidase__InfluenzaA__ADW10735

SEQ ID NO: 172756 - RNA, 1413 nt, Artificial Sequence; identical to SEQ ID NO: 172725
  derived and/or modified sequence opt4 from neuraminidase__InfluenzaA__ADW10746

SEQ ID NO: 172757 - RNA, 1413 nt, Artificial Sequence
  derived and/or modified sequence opt4 from neuraminidase__InfluenzaA__ADW10757
augaaccccaaccagaagaucaucaccaucggcagcaucagcaucgccaucggcaucaucagccugaugcugcagaucggcaacaucaucagcaucugggccagccacagcauccagaccagaagccagaacaacaccggcaucugcaaccagagaaucaucaccuacgagaacagcaccugggugaaccacaccuacgugaacaucaacaacaccaacgugguggccggcggcgacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucacccugaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172758 - RNA, 1413 nt, Artificial Sequence; identical to SEQ ID NO: 172724
  derived and/or modified sequence opt4 from neuraminidase__InfluenzaA__ADW10768

SEQ ID NO: 172759 - RNA, 1413 nt, Artificial Sequence; identical to SEQ ID NO: 169981
  derived and/or modified sequence opt4 from neuraminidase__InfluenzaA__ADW10779

SEQ ID NO: 172760 - RNA, 1413 nt, Artificial Sequence
  derived and/or modified sequence opt4 from neuraminidase__InfluenzaA__ADW10790
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucauccccugcuucuggguggagcuggugagaggccugcccagagagaacgccaccaucuggaccagcggcagcagcaucagcuucugcggcgugaacagcgacaccgccaacuggagcuggcccgacggcgccgagcugcccuucaccaucgacaaguga

SEQ ID NO: 172761 - RNA, 1413 nt, Artificial Sequence; identical to SEQ ID NO: 171450
  derived and/or modified sequence opt4 from neuraminidase__InfluenzaA__ADW10801

SEQ ID NO: 172762 - RNA, 1413 nt, Artificial Sequence; identical to SEQ ID NO: 172724
  derived and/or modified sequence opt4 from neuraminidase__InfluenzaA__ADW10812

SEQ ID NO: 172763 - RNA, 1413 nt, Artificial Sequence; identical to SEQ ID NO: 172476
  derived and/or modified sequence opt4 from neuraminidase__InfluenzaA__ADW10823

SEQ ID NO: 172764 - RNA, 1413 nt, Artificial Sequence
  derived and/or modified sequence opt4 from neuraminidase__InfluenzaA__ADW10834
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaucaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172765 - RNA, 1413 nt, Artificial Sequence; identical to SEQ ID NO: 172725
  derived and/or modified sequence opt4 from neuraminidase__InfluenzaA__ADW10845

SEQ ID NO: 172766 - RNA, 1413 nt, Artificial Sequence
  derived and/or modified sequence opt4 from neuraminidase__InfluenzaA__ADW10856
augaaccccaaccagagaaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcaugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172767 - RNA, 1413 nt, Artificial Sequence; identical to SEQ ID NO: 172724
  derived and/or modified sequence opt4 from neuraminidase__InfluenzaA__ADW10867

SEQ ID NO: 172768 - RNA, 1413 nt, Artificial Sequence; identical to SEQ ID NO: 172724
  derived and/or modified sequence opt4 from neuraminidase__InfluenzaA__ADW10878

SEQ ID NO: 172769 - RNA, 1413 nt, Artificial Sequence; identical to SEQ ID NO: 172724
  derived and/or modified sequence opt4 from neuraminidase__InfluenzaA__ADW10889

SEQ ID NO: 172770 - RNA, 1413 nt, Artificial Sequence; identical to SEQ ID NO: 169981
  derived and/or modified sequence opt4 from neuraminidase__InfluenzaA__ADW10900

SEQ ID NO: 172771 - RNA, 1410 nt, Artificial Sequence; identical to SEQ ID NO: 171004
  derived and/or modified sequence opt4 from neuraminidase__InfluenzaA__ADW11155

SEQ ID NO: 172772 - RNA, 1410 nt, Artificial Sequence; identical to SEQ ID NO: 169258
  derived and/or modified sequence opt4 from neuraminidase__InfluenzaA__ADW23530

SEQ ID NO: 172773 - RNA, 1410 nt, Artificial Sequence
  derived and/or modified sequence opt4 from neuraminidase__InfluenzaA__ADW54483
augaaccccaaccagaagaucaucaccaucggcagcgugugcaugaccaucggcauggccaaccugaugcugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172774 - RNA, 1410 nt, Artificial Sequence
  derived and/or modified sequence opt4 from neuraminidase__InfluenzaA__ADW54494
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172775 - RNA, 1410 nt, Artificial Sequence
  derived and/or modified sequence opt4 from neuraminidase__InfluenzaA__ADW54514
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggaagaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaagaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172776 - RNA, 1410 nt, Artificial Sequence
  derived and/or modified sequence opt4 from neuraminidase__InfluenzaA__ADW54522
augaaccccaaccagaagaucaucaccaucggcagcgugugcaugaucaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacagacugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172777 - RNA, 1410 nt, Artificial Sequence
  derived and/or modified sequence opt4 from neuraminidase__InfluenzaA__ADW65826
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172778 - RNA, 1410 nt, Artificial Sequence; identical to SEQ ID NO: 169119
  derived and/or modified sequence opt4 from neuraminidase__InfluenzaA__ADW80519

SEQ ID NO: 172779 - RNA, 1410 nt, Artificial Sequence; identical to SEQ ID NO: 169119
  derived and/or modified sequence opt4 from neuraminidase__InfluenzaA__ADW82127

SEQ ID NO: 172780 - RNA, 1410 nt, Artificial Sequence; identical to SEQ ID NO: 169119
  derived and/or modified sequence opt4 from neuraminidase__InfluenzaA__ADW82138

SEQ ID NO: 172781 - RNA, 1410 nt, Artificial Sequence; identical to SEQ ID NO: 169119
  derived and/or modified sequence opt4 from neuraminidase__InfluenzaA__ADW82149

SEQ ID NO: 172782 - RNA, 1410 nt, Artificial Sequence; identical to SEQ ID NO: 169119
  derived and/or modified sequence opt4 from neuraminidase__InfluenzaA__ADW82158

SEQ ID NO: 172783 - RNA, 1410 nt, Artificial Sequence; identical to SEQ ID NO: 169119
  derived and/or modified sequence opt4 from neuraminidase__InfluenzaA__ADW82169

SEQ ID NO: 172784 - RNA, 1410 nt, Artificial Sequence; identical to SEQ ID NO: 169119
  derived and/or modified sequence opt4 from neuraminidase__InfluenzaA__ADW82180

SEQ ID NO: 172785 - RNA, 1410 nt, Artificial Sequence; identical to SEQ ID NO: 169258
  derived and/or modified sequence opt4 from neuraminidase__InfluenzaA__ADW82191

SEQ ID NO: 172786 - RNA, 1410 nt, Artificial Sequence; identical to SEQ ID NO: 169258
  derived and/or modified sequence opt4 from neuraminidase__InfluenzaA__ADW82201

SEQ ID NO: 172787 - RNA, 1410 nt, Artificial Sequence; identical to SEQ ID NO: 169258
  derived and/or modified sequence opt4 from neuraminidase__InfluenzaA__ADW82211

SEQ ID NO: 172788 - RNA, 1410 nt, Artificial Sequence; identical to SEQ ID NO: 169258
  derived and/or modified sequence opt4 from neuraminidase__InfluenzaA__ADW82221

SEQ ID NO: 172789 - RNA, 1410 nt, Artificial Sequence; identical to SEQ ID NO: 169258
  derived and/or modified sequence opt4 from neuraminidase__InfluenzaA__ADW82231

SEQ ID NO: 172790 - RNA, 1410 nt, Artificial Sequence; identical to SEQ ID NO: 169258
  derived and/or modified sequence opt4 from neuraminidase__InfluenzaA__ADW82241

SEQ ID NO: 172791 - RNA, 1410 nt, Artificial Sequence; identical to SEQ ID NO: 169258
  derived and/or modified sequence opt4 from neuraminidase__InfluenzaA__ADW82251

SEQ ID NO: 172792 - RNA, 1410 nt, Artificial Sequence; identical to SEQ ID NO: 169258
  derived and/or modified sequence opt4 from neuraminidase__InfluenzaA__ADW82261

SEQ ID NO: 172793 - RNA, 1410 nt, Artificial Sequence; identical to SEQ ID NO: 169258
  derived and/or modified sequence opt4 from neuraminidase__InfluenzaA__ADW82271

SEQ ID NO: 172794 - RNA, 1410 nt, Artificial Sequence; identical to SEQ ID NO: 172777
  derived and/or modified sequence opt4 from neuraminidase__InfluenzaA__ADW95306

SEQ ID NO: 172795 - RNA, 1410 nt, Artificial Sequence; identical to SEQ ID NO: 172777
  derived and/or modified sequence opt4 from neuraminidase__InfluenzaA__ADW95313

SEQ ID NO: 172796 - RNA, 1410 nt, Artificial Sequence; identical to SEQ ID NO: 172777
  derived and/or modified sequence opt4 from neuraminidase__InfluenzaA__ADW95320

SEQ ID NO: 172797 - RNA, 1410 nt, Artificial Sequence; identical to SEQ ID NO: 172777
  derived and/or modified sequence opt4 from neuraminidase__InfluenzaA__ADW95327

SEQ ID NO: 172798 - RNA, 1410 nt, Artificial Sequence
  derived and/or modified sequence opt4 from neuraminidase__InfluenzaA__ADW95333
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagcgccaagagcaucagcagcagaaaggccuucgagaugaucugggaccccaacggcuggaccggcaccgacaacaacuucagcaucaagcaguacaucgugggcaucaacgaguggagcggcuacagcggcagcuucguggagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172799 - RNA, 1410 nt, Artificial Sequence
  derived and/or modified sequence opt4 from neuraminidase__InfluenzaA__ADX20813
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagcugguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccagaccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172800 - RNA, 1410 nt, Artificial Sequence
  derived and/or modified sequence opt4 from neuraminidase__InfluenzaA__ADX20814
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172801 - RNA, 1410 nt, Artificial Sequence; identical to SEQ ID NO: 169119
  derived and/or modified sequence opt4 from neuraminidase__InfluenzaA__ADX21091

SEQ ID NO: 172802 - RNA, 1410 nt, Artificial Sequence; identical to SEQ ID NO: 169258
  derived and/or modified sequence opt4 from neuraminidase__InfluenzaA__ADX21101

SEQ ID NO: 172803 - RNA, 1410 nt, Artificial Sequence; identical to SEQ ID NO: 170125
  derived and/or modified sequence opt4 from neuraminidase__InfluenzaA__ADX36112

SEQ ID NO: 172804 - RNA, 1410 nt, Artificial Sequence
  derived and/or modified sequence opt4 from neuraminidase__InfluenzaA__ADX87386
augaaccccaaccagagaaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 172805 - RNA, 1410 nt, Artificial Sequence
  derived and/or modified sequence opt4 from neuraminidase__InfluenzaA__ADX96270
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggccagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172806 - RNA, 1410 nt, Artificial Sequence; identical to SEQ ID NO: 172805
  derived and/or modified sequence opt4 from neuraminidase__InfluenzaA__ADX96280

SEQ ID NO: 172807 - RNA, 1410 nt, Artificial Sequence; identical to SEQ ID NO: 169841
  derived and/or modified sequence opt4 from neuraminidase__InfluenzaA__ADX96290

SEQ ID NO: 172808 - RNA, 1410 nt, Artificial Sequence; identical to SEQ ID NO: 169258
  derived and/or modified sequence opt4 from neuraminidase__InfluenzaA__ADX96300

SEQ ID NO: 172809 - RNA, 1410 nt, Artificial Sequence; identical to SEQ ID NO: 169258
  derived and/or modified sequence opt4 from neuraminidase__InfluenzaA__ADX96310

SEQ ID NO: 172810 - RNA, 1410 nt, Artificial Sequence
  derived and/or modified sequence opt4 from neuraminidase__InfluenzaA__ADX96330
augaaccccaaccagaagaucaucaccaucggcagcgugugcaugaccaucggcauggccaaccugauccugcagaucggcaacggcaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcaacgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172811 - RNA, 1410 nt, Artificial Sequence; identical to SEQ ID NO: 169258
  derived and/or modified sequence opt4 from neuraminidase__InfluenzaA__ADX96339

SEQ ID NO: 172812 - RNA, 1410 nt, Artificial Sequence
  derived and/or modified sequence opt4 from neuraminidase__InfluenzaA__ADX96349
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcaacgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172813 - RNA, 1410 nt, Artificial Sequence; identical to SEQ ID NO: 169258
  derived and/or modified sequence opt4 from neuraminidase__InfluenzaA__ADX96359

SEQ ID NO: 172814 - RNA, 1410 nt, Artificial Sequence; identical to SEQ ID NO: 169258
  derived and/or modified sequence opt4 from neuraminidase__InfluenzaA__ADX96369

SEQ ID NO: 172815 - RNA, 1410 nt, Artificial Sequence
  derived and/or modified sequence opt4 from neuraminidase__InfluenzaA__ADX96380
augaaccccaaccagaagaucaucaccaucggcagcgugugcaugaccaucggcauggccaaccugauccugcagaucggcaacaucaucagcaucuggcccgugcacagcauccagcugggcaaccagaaccagaucgagaccugcaaccagagcgugaucaccuacgagaacaacaccugggugaaccagaccuacgugaacaucagcaacaccaacuucgccgccggccagagcguggugagcaugaagcuggccggcaacagcagccugugccccgugggcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucguggagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172816 - RNA, 1410 nt, Artificial Sequence
  derived and/or modified sequence opt4 from neuraminidase__InfluenzaA__ADX96390
augaaccccaaccagaagaucaucaccaucggcagcgugugcaugaccaucggcauggccaaccugauccugcagaucggcaacaucaucagcaucuggcugagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172817 - RNA, 1410 nt, Artificial Sequence; identical to SEQ ID NO: 169258
  derived and/or modified sequence opt4 from neuraminidase__InfluenzaA__ADX96400

SEQ ID NO: 172818 - RNA, 1410 nt, Artificial Sequence; identical to SEQ ID NO: 169258
  derived and/or modified sequence opt4 from neuraminidase__InfluenzaA__ADX96410

SEQ ID NO: 172819 - RNA, 1410 nt, Artificial Sequence; identical to SEQ ID NO: 169258
  derived and/or modified sequence opt4 from neuraminidase__InfluenzaA__ADX96419

SEQ ID NO: 172820 - RNA, 1410 nt, Artificial Sequence
  derived and/or modified sequence opt4 from neuraminidase__InfluenzaA__ADX96429
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugagaaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172821 - RNA, 1410 nt, Artificial Sequence; identical to SEQ ID NO: 169258
  derived and/or modified sequence opt4 from neuraminidase__InfluenzaA__ADX96449

SEQ ID NO: 172822 - RNA, 1410 nt, Artificial Sequence; identical to SEQ ID NO: 169258
  derived and/or modified sequence opt4 from neuraminidase__InfluenzaA__ADX96469

SEQ ID NO: 172823 - RNA, 1410 nt, Artificial Sequence; identical to SEQ ID NO: 169258
  derived and/or modified sequence opt4 from neuraminidase__InfluenzaA__ADX96489

SEQ ID NO: 172824 - RNA, 1410 nt, Artificial Sequence; identical to SEQ ID NO: 169258
  derived and/or modified sequence opt4 from neuraminidase__InfluenzaA__ADX96499

SEQ ID NO: 172825 - RNA, 1410 nt, Artificial Sequence
  derived and/or modified sequence opt4 from neuraminidase__InfluenzaA__ADX96509
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaacggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172826 - RNA, 1410 nt, Artificial Sequence; identical to SEQ ID NO: 169258
  derived and/or modified sequence opt4 from neuraminidase__InfluenzaA__ADX96519

SEQ ID NO: 172827 - RNA, 1410 nt, Artificial Sequence; identical to SEQ ID NO: 169258
  derived and/or modified sequence opt4 from neuraminidase__InfluenzaA__ADX96529

SEQ ID NO: 172828 - RNA, 1410 nt, Artificial Sequence; identical to SEQ ID NO: 169258
  derived and/or modified sequence opt4 from neuraminidase__InfluenzaA__ADX96539

SEQ ID NO: 172829 - RNA, 1410 nt, Artificial Sequence; identical to SEQ ID NO: 169258
  derived and/or modified sequence opt4 from neuraminidase__InfluenzaA__ADX96549

SEQ ID NO: 172830 - RNA, 1410 nt, Artificial Sequence; identical to SEQ ID NO: 169258
  derived and/or modified sequence opt4 from neuraminidase__InfluenzaA__ADX96559

SEQ ID NO: 172831 - RNA, 1410 nt, Artificial Sequence; identical to SEQ ID NO: 169258
  derived and/or modified sequence opt4 from neuraminidase__InfluenzaA__ADX96569

SEQ ID NO: 172832 - RNA, 1410 nt, Artificial Sequence; identical to SEQ ID NO: 169248
  derived and/or modified sequence opt4 from neuraminidase__InfluenzaA__ADX96579

SEQ ID NO: 172833 - RNA, 1410 nt, Artificial Sequence; identical to SEQ ID NO: 169258
  derived and/or modified sequence opt4 from neuraminidase__InfluenzaA__ADX96589

SEQ ID NO: 172834 - RNA, 1410 nt, Artificial Sequence; identical to SEQ ID NO: 169258
  derived and/or modified sequence opt4 from neuraminidase__InfluenzaA__ADX96599

SEQ ID NO: 172835 - RNA, 1410 nt, Artificial Sequence
  derived and/or modified sequence opt4 from neuraminidase__InfluenzaA__ADX96609
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugggcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcgacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172836 - RNA, 1410 nt, Artificial Sequence; identical to SEQ ID NO: 169248
  derived and/or modified sequence opt4 from neuraminidase__InfluenzaA__ADX96619

SEQ ID NO: 172837 - RNA, 1410 nt, Artificial Sequence; identical to SEQ ID NO: 169258
  derived and/or modified sequence opt4 from neuraminidase__InfluenzaA__ADX96629

SEQ ID NO: 172838 - RNA, 1410 nt, Artificial Sequence; identical to SEQ ID NO: 169258
  derived and/or modified sequence opt4 from neuraminidase__InfluenzaA__ADX96639

SEQ ID NO: 172839 - RNA, 1410 nt, Artificial Sequence; identical to SEQ ID NO: 169258
  derived and/or modified sequence opt4 from neuraminidase__InfluenzaA__ADX96649

SEQ ID NO: 172840 - RNA, 1410 nt, Artificial Sequence; identical to SEQ ID NO: 169248
  derived and/or modified sequence opt4 from neuraminidase__InfluenzaA__ADX96659

SEQ ID NO: 172841 - RNA, 1410 nt, Artificial Sequence; identical to SEQ ID NO: 169258
  derived and/or modified sequence opt4 from neuraminidase__InfluenzaA__ADX96669

SEQ ID NO: 172842 - RNA, 1410 nt, Artificial Sequence; identical to SEQ ID NO: 169258
  derived and/or modified sequence opt4 from neuraminidase__InfluenzaA__ADX96679

SEQ ID NO: 172843 - RNA, 1410 nt, Artificial Sequence; identical to SEQ ID NO: 169258
  derived and/or modified sequence opt4 from neuraminidase__InfluenzaA__ADX96689

SEQ ID NO: 172844 - RNA, 1410 nt, Artificial Sequence; identical to SEQ ID NO: 169258
  derived and/or modified sequence opt4 from neuraminidase__InfluenzaA__ADX96699

SEQ ID NO: 172845 - RNA, 1410 nt, Artificial Sequence
  derived and/or modified sequence opt4 from neuraminidase__InfluenzaA__ADX96709
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaucaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacgagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172846 - RNA, 1410 nt, Artificial Sequence
  derived and/or modified sequence opt4 from neuraminidase__InfluenzaA__ADX96719
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaaguucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagagcaccguguggaccagcggcagcagcaucagcuucugcggcgugaacagcgacaccgugggcuggagcuggcccgacggcgccgagcugcccuucaccaucgacaaguga

SEQ ID NO: 172847 - RNA, 1410 nt, Artificial Sequence; identical to SEQ ID NO: 169258
  derived and/or modified sequence opt4 from neuraminidase__InfluenzaA__ADX96729

SEQ ID NO: 172848 - RNA, 1410 nt, Artificial Sequence
  derived and/or modified sequence opt4 from neuraminidase__InfluenzaA__ADX96739
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaagagcgacaccgugggcuggagcuggcccgacggcgccgagcugcccuucaccaucgacaaguga

SEQ ID NO: 172849 - RNA, 1410 nt, Artificial Sequence; identical to SEQ ID NO: 169258
  derived and/or modified sequence opt4 from neuraminidase__InfluenzaA__ADX96749

SEQ ID NO: 172850 - RNA, 1410 nt, Artificial Sequence; identical to SEQ ID NO: 169258
  derived and/or modified sequence opt4 from neuraminidase__InfluenzaA__ADX96759

SEQ ID NO: 172851 - RNA, 1410 nt, Artificial Sequence; identical to SEQ ID NO: 170232
  derived and/or modified sequence opt4 from neuraminidase__InfluenzaA__ADX96769

SEQ ID NO: 172852 - RNA, 1410 nt, Artificial Sequence; identical to SEQ ID NO: 169258
  derived and/or modified sequence opt4 from neuraminidase__InfluenzaA__ADX96779

SEQ ID NO: 172853 - RNA, 1410 nt, Artificial Sequence
  derived and/or modified sequence opt4 from neuraminidase__InfluenzaA__ADX96789
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagccugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172854 - RNA, 1410 nt, Artificial Sequence; identical to SEQ ID NO: 169258
  derived and/or modified sequence opt4 from neuraminidase__InfluenzaA__ADX96799

SEQ ID NO: 172855 - RNA, 1410 nt, Artificial Sequence; identical to SEQ ID NO: 169413
  derived and/or modified sequence opt4 from neuraminidase__InfluenzaA__ADX96809

SEQ ID NO: 172856 - RNA, 1410 nt, Artificial Sequence; identical to SEQ ID NO: 169258
  derived and/or modified sequence opt4 from neuraminidase__InfluenzaA__ADX96819

SEQ ID NO: 172857 - RNA, 1410 nt, Artificial Sequence; identical to SEQ ID NO: 170481
  derived and/or modified sequence opt4 from neuraminidase__InfluenzaA__ADX96829

SEQ ID NO: 172858 - RNA, 1410 nt, Artificial Sequence
  derived and/or modified sequence opt4 from neuraminidase__InfluenzaA__ADX96839
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacaacgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172859 - RNA, 1410 nt, Artificial Sequence; identical to SEQ ID NO: 169258
  derived and/or modified sequence opt4 from neuraminidase__InfluenzaA__ADX96849

SEQ ID NO: 172860 - RNA, 1410 nt, Artificial Sequence; identical to SEQ ID NO: 169258
  derived and/or modified sequence opt4 from neuraminidase__InfluenzaA__ADX96859

SEQ ID NO: 172861 - RNA, 1410 nt, Artificial Sequence; identical to SEQ ID NO: 170481
  derived and/or modified sequence opt4 from neuraminidase__InfluenzaA__ADX96869

SEQ ID NO: 172862 - RNA, 1410 nt, Artificial Sequence; identical to SEQ ID NO: 169258
  derived and/or modified sequence opt4 from neuraminidase__InfluenzaA__ADX96879

SEQ ID NO: 172863 - RNA, 1410 nt, Artificial Sequence; identical to SEQ ID NO: 169258
  derived and/or modified sequence opt4 from neuraminidase__InfluenzaA__ADX96899

SEQ ID NO: 172864 - RNA, 1410 nt, Artificial Sequence
  derived and/or modified sequence opt4 from neuraminidase__InfluenzaA__ADX96909
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacgacauccugagaacccaggagagcgagugcgccugcgugaacggcagcugcuucaccgugaugaccgacggccccagcgacggccaggccagcuacaagaucuucagaaucgagaagggcaagaucgugaagagcguggagaucaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaacagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172865 - RNA, 1410 nt, Artificial Sequence; identical to SEQ ID NO: 169258
  derived and/or modified sequence opt4 from neuraminidase__InfluenzaA__ADX96919

SEQ ID NO: 172866 - RNA, 1410 nt, Artificial Sequence; identical to SEQ ID NO: 169258
  derived and/or modified sequence opt4 from neuraminidase__InfluenzaA__ADX96929

SEQ ID NO: 172867 - RNA, 1410 nt, Artificial Sequence; identical to SEQ ID NO: 169258
  derived and/or modified sequence opt4 from neuraminidase__InfluenzaA__ADX96939

SEQ ID NO: 172868 - RNA, 1410 nt, Artificial Sequence; identical to SEQ ID NO: 169841
  derived and/or modified sequence opt4 from neuraminidase__InfluenzaA__ADX96949

SEQ ID NO: 172869 - RNA, 1410 nt, Artificial Sequence; identical to SEQ ID NO: 169258
  derived and/or modified sequence opt4 from neuraminidase__InfluenzaA__ADX96959

SEQ ID NO: 172870 - RNA, 1410 nt, Artificial Sequence
  derived and/or modified sequence opt4 from neuraminidase__InfluenzaA__ADX96969
augaaccccaaccagaugaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172871 - RNA, 1410 nt, Artificial Sequence; identical to SEQ ID NO: 170481
  derived and/or modified sequence opt4 from neuraminidase__InfluenzaA__ADX96979

SEQ ID NO: 172872 - RNA, 1410 nt, Artificial Sequence; identical to SEQ ID NO: 170481
  derived and/or modified sequence opt4 from neuraminidase__InfluenzaA__ADX96989

SEQ ID NO: 172873 - RNA, 1407 nt, Artificial Sequence
  derived and/or modified sequence opt4 from neuraminidase__InfluenzaA__ADX96999
augaaccccaaccagaagaucaucaccaucggcagcgugugcaugaccaucggcauggccaaccugauccugcagaucggcaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172874 - RNA, 1410 nt, Artificial Sequence; identical to SEQ ID NO: 169258
  derived and/or modified sequence opt4 from neuraminidase__InfluenzaA__ADX97009

SEQ ID NO: 172875 - RNA, 1410 nt, Artificial Sequence; identical to SEQ ID NO: 169413
  derived and/or modified sequence opt4 from neuraminidase__InfluenzaA__ADX97020

SEQ ID NO: 172876 - RNA, 1410 nt, Artificial Sequence
  derived and/or modified sequence opt4 from neuraminidase__InfluenzaA__ADX97030
augaaccccaaccagaagaucaucaccaucggcagcgugugcaugaucaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172877 - RNA, 1410 nt, Artificial Sequence; identical to SEQ ID NO: 170806
  derived and/or modified sequence opt4 from neuraminidase__InfluenzaA__ADX98643

SEQ ID NO: 172878 - RNA, 1410 nt, Artificial Sequence; identical to SEQ ID NO: 169258
  derived and/or modified sequence opt4 from neuraminidase__InfluenzaA__ADX98653

SEQ ID NO: 172879 - RNA, 1410 nt, Artificial Sequence
  derived and/or modified sequence opt4 from neuraminidase__InfluenzaA__ADX98668
augaaccccaaccagaagaucaucaccaucggcagcaucugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172880 - RNA, 1410 nt, Artificial Sequence; identical to SEQ ID NO: 169258
  derived and/or modified sequence opt4 from neuraminidase__InfluenzaA__ADX98678

SEQ ID NO: 172881 - RNA, 1410 nt, Artificial Sequence; identical to SEQ ID NO: 169258
  derived and/or modified sequence opt4 from neuraminidase__InfluenzaA__ADX98698

SEQ ID NO: 172882 - RNA, 1410 nt, Artificial Sequence
  derived and/or modified sequence opt4 from neuraminidase__InfluenzaA__ADX98708
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaucuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172883 - RNA, 1410 nt, Artificial Sequence; identical to SEQ ID NO: 169258
  derived and/or modified sequence opt4 from neuraminidase__InfluenzaA__ADX98722

SEQ ID NO: 172884 - RNA, 1410 nt, Artificial Sequence; identical to SEQ ID NO: 169258
  derived and/or modified sequence opt4 from neuraminidase__InfluenzaA__ADX98732

SEQ ID NO: 172885 - RNA, 1410 nt, Artificial Sequence; identical to SEQ ID NO: 169258
  derived and/or modified sequence opt4 from neuraminidase__InfluenzaA__ADX98742

SEQ ID NO: 172886 - RNA, 1410 nt, Artificial Sequence; identical to SEQ ID NO: 170609
  derived and/or modified sequence opt4 from neuraminidase__InfluenzaA__ADX98751

SEQ ID NO: 172887 - RNA, 1410 nt, Artificial Sequence; identical to SEQ ID NO: 169258
  derived and/or modified sequence opt4 from neuraminidase__InfluenzaA__ADX98761

SEQ ID NO: 172888 - RNA, 1410 nt, Artificial Sequence
  derived and/or modified sequence opt4 from neuraminidase__InfluenzaA__ADX98770
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccuggggcagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172889 - RNA, 1410 nt, Artificial Sequence; identical to SEQ ID NO: 169258
  derived and/or modified sequence opt4 from neuraminidase__InfluenzaA__ADX98780

SEQ ID NO: 172890 - RNA, 1410 nt, Artificial Sequence
  derived and/or modified sequence opt4 from neuraminidase__InfluenzaA__ADX98788
augaaccccaaccagaagaucaucaccaucggcagcgugugcaugaccaucggcauggccaaccuggugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172891 - RNA, 1410 nt, Artificial Sequence
  derived and/or modified sequence opt4 from neuraminidase__InfluenzaA__ADX98809
augaaccccaaccagaagaucaucaccaucggcagcgugugcaugaccaucggcauggccaaccugauccugcagaucggcaacaucauccugaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172892 - RNA, 1410 nt, Artificial Sequence; identical to SEQ ID NO: 169258
  derived and/or modified sequence opt4 from neuraminidase__InfluenzaA__ADX98821

SEQ ID NO: 172893 - RNA, 1410 nt, Artificial Sequence; identical to SEQ ID NO: 169258
  derived and/or modified sequence opt4 from neuraminidase__InfluenzaA__ADX98846

SEQ ID NO: 172894 - RNA, 1410 nt, Artificial Sequence
  derived and/or modified sequence opt4 from neuraminidase__InfluenzaA__ADX98856
augaaccccaaccagaagaucaugaccaucggcagcgugugcaugaccaucggcauggccaaccugauccugcagaucggcaacaucaucagcaucuggaucagccacagcauccagcugggcauccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172895 - RNA, 1410 nt, Artificial Sequence; identical to SEQ ID NO: 169258
  derived and/or modified sequence opt4 from neuraminidase__InfluenzaA__ADX98863

SEQ ID NO: 172896 - RNA, 1410 nt, Artificial Sequence; identical to SEQ ID NO: 169258
  derived and/or modified sequence opt4 from neuraminidase__InfluenzaA__ADX98873

SEQ ID NO: 172897 - RNA, 1410 nt, Artificial Sequence
  derived and/or modified sequence opt4 from neuraminidase__InfluenzaA__ADX98883
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacguggccgccggccagagcguggugagcgugaagcuggccggcaacagcagccugugccccgugagcggcugggccaucuacagcaaggacaacagcaucagaaucggcagcaagggcgacgccuucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaagcggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172898 - RNA, 1410 nt, Artificial Sequence; identical to SEQ ID NO: 169258
  derived and/or modified sequence opt4 from neuraminidase__InfluenzaA__ADX98893

SEQ ID NO: 172899 - RNA, 1410 nt, Artificial Sequence; identical to SEQ ID NO: 169258
  derived and/or modified sequence opt4 from neuraminidase__InfluenzaA__ADX98903

SEQ ID NO: 172900 - RNA, 1410 nt, Artificial Sequence; identical to SEQ ID NO: 170811
  derived and/or modified sequence opt4 from neuraminidase__InfluenzaA__ADX98913

SEQ ID NO: 172901 - RNA, 1410 nt, Artificial Sequence; identical to SEQ ID NO: 170689
  derived and/or modified sequence opt4 from neuraminidase__InfluenzaA__ADX98923

SEQ ID NO: 172902 - RNA, 1410 nt, Artificial Sequence; identical to SEQ ID NO: 170695
  derived and/or modified sequence opt4 from neuraminidase__InfluenzaA__ADX98933

SEQ ID NO: 172903 - RNA, 1410 nt, Artificial Sequence; identical to SEQ ID NO: 169258
  derived and/or modified sequence opt4 from neuraminidase__InfluenzaA__ADX98943

SEQ ID NO: 172904 - RNA, 1410 nt, Artificial Sequence; identical to SEQ ID NO: 171215
  derived and/or modified sequence opt4 from neuraminidase__InfluenzaA__ADX98953

SEQ ID NO: 172905 - RNA, 1410 nt, Artificial Sequence; identical to SEQ ID NO: 169258
  derived and/or modified sequence opt4 from neuraminidase__InfluenzaA__ADX98963

SEQ ID NO: 172906 - RNA, 1410 nt, Artificial Sequence
  derived and/or modified sequence opt4 from neuraminidase__InfluenzaA__ADX98973
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugaucugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172907 - RNA, 1410 nt, Artificial Sequence; identical to SEQ ID NO: 169258
  derived and/or modified sequence opt4 from neuraminidase__InfluenzaA__ADX98983

SEQ ID NO: 172908 - RNA, 1410 nt, Artificial Sequence; identical to SEQ ID NO: 169258
  derived and/or modified sequence opt4 from neuraminidase__InfluenzaA__ADX98993

SEQ ID NO: 172909 - RNA, 1410 nt, Artificial Sequence; identical to SEQ ID NO: 169258
  derived and/or modified sequence opt4 from neuraminidase__InfluenzaA__ADX99003

SEQ ID NO: 172910 - RNA, 1365 nt, Artificial Sequence
  derived and/or modified sequence opt4 from neuraminidase__InfluenzaA__ADX99584
augaaccccaaccagaagaucaccaccaucggcagcaucugccugguggugggccugaucagccugauccugcagaucggcaacaucaucagcaucuggaucagccacagcauccagaccggcagccagaaccacaccggcaucugcaaccagaacaucaucaccuacaagaacagcaccugggugaaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccgaggacggcaccggcagcugcggccccguguacguggacggcgccaacggcgugaagggcuucagcuacagauacggcaacggcguguggaucggcagaaccaagagccacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaugagacccugcuucuggguggagcugaucagaggcagacccaaggagaagaccaucuggaccagcgccagcagcaucagcuucugcggcgugaacagcgacaccguggacuggagcuggcccgacggcgccgagcugcccuucagcaucgacaaguga

SEQ ID NO: 172911 - RNA, 1365 nt, Artificial Sequence; identical to SEQ ID NO: 172910
  derived and/or modified sequence opt4 from neuraminidase__InfluenzaA__ADX99595

SEQ ID NO: 172912 - RNA, 1365 nt, Artificial Sequence; identical to SEQ ID NO: 172910
  derived and/or modified sequence opt4 from neuraminidase__InfluenzaA__ADX99606

SEQ ID NO: 172913 - RNA, 1365 nt, Artificial Sequence; identical to SEQ ID NO: 172910
  derived and/or modified sequence opt4 from neuraminidase__InfluenzaA__ADX99617

SEQ ID NO: 172914 - RNA, 1365 nt, Artificial Sequence; identical to SEQ ID NO: 172910
  derived and/or modified sequence opt4 from neuraminidase__InfluenzaA__ADX99628

SEQ ID NO: 172915 - RNA, 1365 nt, Artificial Sequence; identical to SEQ ID NO: 172910
  derived and/or modified sequence opt4 from neuraminidase__InfluenzaA__ADX99639

SEQ ID NO: 172916 - RNA, 1365 nt, Artificial Sequence; identical to SEQ ID NO: 168239
  derived and/or modified sequence opt4 from neuraminidase__InfluenzaA__ADX99650

SEQ ID NO: 172917 - RNA, 1365 nt, Artificial Sequence; identical to SEQ ID NO: 168239
  derived and/or modified sequence opt4 from neuraminidase__InfluenzaA__ADX99672

SEQ ID NO: 172918 - RNA, 1365 nt, Artificial Sequence; identical to SEQ ID NO: 168239
  derived and/or modified sequence opt4 from neuraminidase__InfluenzaA__ADX99683

SEQ ID NO: 172919 - RNA, 1365 nt, Artificial Sequence; identical to SEQ ID NO: 168239
  derived and/or modified sequence opt4 from neuraminidase__InfluenzaA__ADX99694

SEQ ID NO: 172920 - RNA, 1365 nt, Artificial Sequence; identical to SEQ ID NO: 168239
  derived and/or modified sequence opt4 from neuraminidase__InfluenzaA__ADX99705

SEQ ID NO: 172921 - RNA, 1365 nt, Artificial Sequence; identical to SEQ ID NO: 168239
  derived and/or modified sequence opt4 from neuraminidase__InfluenzaA__ADX99846

SEQ ID NO: 172922 - RNA, 1365 nt, Artificial Sequence; identical to SEQ ID NO: 168239
  derived and/or modified sequence opt4 from neuraminidase__InfluenzaA__ADX99857

SEQ ID NO: 172923 - RNA, 1365 nt, Artificial Sequence; identical to SEQ ID NO: 168239
  derived and/or modified sequence opt4 from neuraminidase__InfluenzaA__ADX99868

SEQ ID NO: 172924 - RNA, 1365 nt, Artificial Sequence; identical to SEQ ID NO: 168239
  derived and/or modified sequence opt4 from neuraminidase__InfluenzaA__ADX99879

SEQ ID NO: 172925 - RNA, 1365 nt, Artificial Sequence; identical to SEQ ID NO: 168239
  derived and/or modified sequence opt4 from neuraminidase__InfluenzaA__ADX99890

SEQ ID NO: 172926 - RNA, 1365 nt, Artificial Sequence; identical to SEQ ID NO: 168239
  derived and/or modified sequence opt4 from neuraminidase__InfluenzaA__ADX99901

SEQ ID NO: 172927 - RNA, 1365 nt, Artificial Sequence
  derived and/or modified sequence opt4 from neuraminidase__InfluenzaA__ADX99912
augaaccccaaccagaagaucaucaccaucggcagcaucugccugguggugggccugaucagccugauccugcagaucggcaacaucaucagcaucuggaucagccacagcauccagaccggcagccagaaccacaccggcaucugcaaccagaacaucaucaccuacaagaacagcaccugggugaaggacaccaccagcgugauccugaccggcaacagcagccugugccccaucagaggcugggccaucuacagcaaggacaacagcaucagaaucggcagcaagggcgacguguucaucaucagagagcccuucaucagcugcagccaccuggagugcagaaccuucuuccugacccagggcgcccugcugaacgacaagcacagcagcggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccgaggacggcaccggcagcugcggccccguguacguggacggcgccaacggcgugaagggcuucagcuacagauacggcaacggcguguggaucggcagaaccaagagccacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaugagacccugcuucuggguggagcugaucagaggcagacccaaggagaagaccaucuggaccagcgccagcagcaucagcuucugcggcgugaacagcgacaccguggacuggagcuggcccgacggcgccgagcugcccuucagcaucgacaaguga

SEQ ID NO: 172928 - RNA, 1365 nt, Artificial Sequence; identical to SEQ ID NO: 168239
  derived and/or modified sequence opt4 from neuraminidase__InfluenzaA__ADX99923

SEQ ID NO: 172929 - RNA, 1365 nt, Artificial Sequence; identical to SEQ ID NO: 168239
  derived and/or modified sequence opt4 from neuraminidase__InfluenzaA__ADX99934

SEQ ID NO: 172930 - RNA, 1365 nt, Artificial Sequence; identical to SEQ ID NO: 168239
  derived and/or modified sequence opt4 from neuraminidase__InfluenzaA__ADX99956

SEQ ID NO: 172931 - RNA, 1365 nt, Artificial Sequence; identical to SEQ ID NO: 168239
  derived and/or modified sequence opt4 from neuraminidase__InfluenzaA__ADX99967

SEQ ID NO: 172932 - RNA, 1365 nt, Artificial Sequence; identical to SEQ ID NO: 168239
  derived and/or modified sequence opt4 from neuraminidase__InfluenzaA__ADX99978

SEQ ID NO: 172933 - RNA, 1365 nt, Artificial Sequence; identical to SEQ ID NO: 168239
  derived and/or modified sequence opt4 from neuraminidase__InfluenzaA__ADX99989

SEQ ID NO: 172934 - RNA, 1365 nt, Artificial Sequence; identical to SEQ ID NO: 168239
  derived and/or modified sequence opt4 from neuraminidase__InfluenzaA__ADY00001

SEQ ID NO: 172935 - RNA, 1365 nt, Artificial Sequence; identical to SEQ ID NO: 168239
  derived and/or modified sequence opt4 from neuraminidase__InfluenzaA__ADY00012

SEQ ID NO: 172936 - RNA, 1365 nt, Artificial Sequence; identical to SEQ ID NO: 168239
  derived and/or modified sequence opt4 from neuraminidase__InfluenzaA__ADY00023

SEQ ID NO: 172937 - RNA, 1413 nt, Artificial Sequence
  derived and/or modified sequence opt4 from neuraminidase__InfluenzaA__ADY04729
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugaccauggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 172938 - RNA, 1410 nt, Artificial Sequence; identical to SEQ ID NO: 172038
  derived and/or modified sequence opt4 from neuraminidase__InfluenzaA__ADY11828

SEQ ID NO: 172939 - RNA, 1410 nt, Artificial Sequence; identical to SEQ ID NO: 169119
  derived and/or modified sequence opt4 from neuraminidase__InfluenzaA__ADY11839

SEQ ID NO: 172940 - RNA, 1410 nt, Artificial Sequence; identical to SEQ ID NO: 169119
  derived and/or modified sequence opt4 from neuraminidase__InfluenzaA__ADY17657

SEQ ID NO: 172941 - RNA, 1410 nt, Artificial Sequence; identical to SEQ ID NO: 169119
  derived and/or modified sequence opt4 from neuraminidase__InfluenzaA__ADY17668

SEQ ID NO: 172942 - RNA, 1410 nt, Artificial Sequence; identical to SEQ ID NO: 169119
  derived and/or modified sequence opt4 from neuraminidase__InfluenzaA__ADY17679

SEQ ID NO: 172943 - RNA, 1410 nt, Artificial Sequence; identical to SEQ ID NO: 169119
  derived and/or modified sequence opt4 from neuraminidase__InfluenzaA__ADY17690

SEQ ID NO: 172944 - RNA, 1410 nt, Artificial Sequence; identical to SEQ ID NO: 169119
  derived and/or modified sequence opt4 from neuraminidase__InfluenzaA__ADY17701

SEQ ID NO: 172945 - RNA, 1410 nt, Artificial Sequence; identical to SEQ ID NO: 169258
  derived and/or modified sequence opt4 from neuraminidase__InfluenzaA__ADY38722

SEQ ID NO: 172946 - RNA, 1410 nt, Artificial Sequence; identical to SEQ ID NO: 171007
  derived and/or modified sequence opt4 from neuraminidase__InfluenzaA__ADY38723

SEQ ID NO: 172947 - RNA, 1410 nt, Artificial Sequence; identical to SEQ ID NO: 169258
  derived and/or modified sequence opt4 from neuraminidase__InfluenzaA__ADY38734

SEQ ID NO: 172948 - RNA, 1410 nt, Artificial Sequence; identical to SEQ ID NO: 170850
  derived and/or modified sequence opt4 from neuraminidase__InfluenzaA__ADY38753

SEQ ID NO: 172949 - RNA, 1410 nt, Artificial Sequence; identical to SEQ ID NO: 169258
  derived and/or modified sequence opt4 from neuraminidase__InfluenzaA__ADY38763

SEQ ID NO: 172950 - RNA, 1410 nt, Artificial Sequence; identical to SEQ ID NO: 169258
  derived and/or modified sequence opt4 from neuraminidase__InfluenzaA__ADZ04600

SEQ ID NO: 172951 - RNA, 1410 nt, Artificial Sequence; identical to SEQ ID NO: 169258
  derived and/or modified sequence opt4 from neuraminidase__InfluenzaA__ADZ04610

SEQ ID NO: 172952 - RNA, 1410 nt, Artificial Sequence; identical to SEQ ID NO: 169258
  derived and/or modified sequence opt4 from neuraminidase__InfluenzaA__ADZ04693

SEQ ID NO: 172953 - RNA, 1410 nt, Artificial Sequence; identical to SEQ ID NO: 169258
  derived and/or modified sequence opt4 from neuraminidase__InfluenzaA__ADZ04701

SEQ ID NO: 172954 - RNA, 1410 nt, Artificial Sequence; identical to SEQ ID NO: 169258
  derived and/or modified sequence opt4 from neuraminidase__InfluenzaA__ADZ04711

SEQ ID NO: 172955 - RNA, 1410 nt, Artificial Sequence
  derived and/or modified sequence opt4 from neuraminidase__InfluenzaA__ADZ05393
augaaccccaaccagaagaucaucaccaucgacagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172956 - RNA, 1413 nt, Artificial Sequence
  derived and/or modified sequence opt4 from neuraminidase__InfluenzaA__ADZ05837
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccugcgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaccaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172957 - RNA, 1413 nt, Artificial Sequence; identical to SEQ ID NO: 169981
  derived and/or modified sequence opt4 from neuraminidase__InfluenzaA__ADZ05848

SEQ ID NO: 172958 - RNA, 1410 nt, Artificial Sequence; identical to SEQ ID NO: 170425
  derived and/or modified sequence opt4 from neuraminidase__InfluenzaA__ADZ05858

SEQ ID NO: 172959 - RNA, 1410 nt, Artificial Sequence; identical to SEQ ID NO: 169258
  derived and/or modified sequence opt4 from neuraminidase__InfluenzaA__ADZ47841

SEQ ID NO: 172960 - RNA, 1410 nt, Artificial Sequence; identical to SEQ ID NO: 169258
  derived and/or modified sequence opt4 from neuraminidase__InfluenzaA__ADZ47851

SEQ ID NO: 172961 - RNA, 1410 nt, Artificial Sequence
  derived and/or modified sequence opt4 from neuraminidase__InfluenzaA__ADZ47861
augaaccccaaccagaagaucaucaccaucggcagcgugugcaugaccaucggccuggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaucaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaagaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172962 - RNA, 1413 nt, Artificial Sequence
  derived and/or modified sequence opt4 from neuraminidase__InfluenzaA__ADZ53101
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaaggugguggccggcgaggacaagaccagcgugacccuggccggcaacagcagccugugcagcaucagcggcugggccaucaacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 172963 - RNA, 1410 nt, Artificial Sequence
  derived and/or modified sequence opt4 from neuraminidase__InfluenzaA__ADZ53124
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacgacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172964 - RNA, 1410 nt, Artificial Sequence; identical to SEQ ID NO: 169258
  derived and/or modified sequence opt4 from neuraminidase__InfluenzaA__ADZ53130

SEQ ID NO: 172965 - RNA, 1410 nt, Artificial Sequence; identical to SEQ ID NO: 169248
  derived and/or modified sequence opt4 from neuraminidase__InfluenzaA__ADZ53132

SEQ ID NO: 172966 - RNA, 1410 nt, Artificial Sequence; identical to SEQ ID NO: 169258
  derived and/or modified sequence opt4 from neuraminidase__InfluenzaA__ADZ53134

SEQ ID NO: 172967 - RNA, 1410 nt, Artificial Sequence; identical to SEQ ID NO: 169258
  derived and/or modified sequence opt4 from neuraminidase__InfluenzaA__ADZ53136

SEQ ID NO: 172968 - RNA, 1410 nt, Artificial Sequence; identical to SEQ ID NO: 169612
  derived and/or modified sequence opt4 from neuraminidase__InfluenzaA__ADZ53137

SEQ ID NO: 172969 - RNA, 1410 nt, Artificial Sequence; identical to SEQ ID NO: 169258
  derived and/or modified sequence opt4 from neuraminidase__InfluenzaA__ADZ53139

SEQ ID NO: 172970 - RNA, 1410 nt, Artificial Sequence
  derived and/or modified sequence opt4 from neuraminidase__InfluenzaA__ADZ53141
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacgacuucagcaucaagcaggacaucgugggcaucaacgaguggagcggcuacagcggcagcuucgugcagcacagcgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 172971 - RNA, 1410 nt, Artificial Sequence; identical to SEQ ID NO: 169119
  derived and/or modified sequence opt4 from neuraminidase__InfluenzaA__AEA03712

SEQ ID NO: 172972 - RNA, 1410 nt, Artificial Sequence; identical to SEQ ID NO: 169119
  derived and/or modified sequence opt4 from neuraminidase__InfluenzaA__AEA03722

SEQ ID NO: 172973 - RNA, 1410 nt, Artificial Sequence; identical to SEQ ID NO: 169119
  derived and/or modified sequence opt4 from neuraminidase__InfluenzaA__AEA03744

SEQ ID NO: 172974 - RNA, 1410 nt, Artificial Sequence
  derived and/or modified sequence opt4 from neuraminidase__InfluenzaA__AEA03755
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172975 - RNA, 1410 nt, Artificial Sequence; identical to SEQ ID NO: 169119
  derived and/or modified sequence opt4 from neuraminidase__InfluenzaA__AEA03766

SEQ ID NO: 172976 - RNA, 1410 nt, Artificial Sequence; identical to SEQ ID NO: 169119
  derived and/or modified sequence opt4 from neuraminidase__InfluenzaA__AEA03796

SEQ ID NO: 172977 - RNA, 1410 nt, Artificial Sequence; identical to SEQ ID NO: 169119
  derived and/or modified sequence opt4 from neuraminidase__InfluenzaA__AEA03806

SEQ ID NO: 172978 - RNA, 1410 nt, Artificial Sequence
  derived and/or modified sequence opt4 from neuraminidase__InfluenzaA__AEA03817
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacagaugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172979 - RNA, 1410 nt, Artificial Sequence; identical to SEQ ID NO: 169119
  derived and/or modified sequence opt4 from neuraminidase__InfluenzaA__AEA03828

SEQ ID NO: 172980 - RNA, 1410 nt, Artificial Sequence; identical to SEQ ID NO: 169119
  derived and/or modified sequence opt4 from neuraminidase__InfluenzaA__AEA03838

SEQ ID NO: 172981 - RNA, 1410 nt, Artificial Sequence; identical to SEQ ID NO: 172275
  derived and/or modified sequence opt4 from neuraminidase__InfluenzaA__AEA03849

SEQ ID NO: 172982 - RNA, 1410 nt, Artificial Sequence; identical to SEQ ID NO: 169119
  derived and/or modified sequence opt4 from neuraminidase__InfluenzaA__AEA03860

SEQ ID NO: 172983 - RNA, 1410 nt, Artificial Sequence
  derived and/or modified sequence opt4 from neuraminidase__InfluenzaA__AEA03871
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaucaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172984 - RNA, 1410 nt, Artificial Sequence; identical to SEQ ID NO: 169119
  derived and/or modified sequence opt4 from neuraminidase__InfluenzaA__AEA03879

SEQ ID NO: 172985 - RNA, 1410 nt, Artificial Sequence
  derived and/or modified sequence opt4 from neuraminidase__InfluenzaA__AEA03889
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaaggugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172986 - RNA, 1410 nt, Artificial Sequence
  derived and/or modified sequence opt4 from neuraminidase__InfluenzaA__AEA03898
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagagcgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172987 - RNA, 1410 nt, Artificial Sequence; identical to SEQ ID NO: 169119
  derived and/or modified sequence opt4 from neuraminidase__InfluenzaA__AEA03909

SEQ ID NO: 172988 - RNA, 1410 nt, Artificial Sequence
  derived and/or modified sequence opt4 from neuraminidase__InfluenzaA__AEA03924
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172989 - RNA, 1410 nt, Artificial Sequence; identical to SEQ ID NO: 169119
  derived and/or modified sequence opt4 from neuraminidase__InfluenzaA__AEA03935

SEQ ID NO: 172990 - RNA, 1410 nt, Artificial Sequence
  derived and/or modified sequence opt4 from neuraminidase__InfluenzaA__AEA03946
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcgaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172991 - RNA, 1410 nt, Artificial Sequence
  derived and/or modified sequence opt4 from neuraminidase__InfluenzaA__AEA03957
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaacagcaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 172992 - RNA, 1410 nt, Artificial Sequence; identical to SEQ ID NO: 169119
  derived and/or modified sequence opt4 from neuraminidase__InfluenzaA__AEA03989

SEQ ID NO: 172993 - RNA, 1410 nt, Artificial Sequence; identical to SEQ ID NO: 172275
  derived and/or modified sequence opt4 from neuraminidase__InfluenzaA__AEA04000

SEQ ID NO: 172994 - RNA, 1410 nt, Artificial Sequence; identical to SEQ ID NO: 169119
  derived and/or modified sequence opt4 from neuraminidase__InfluenzaA__AEA04011

SEQ ID NO: 172995 - RNA, 1410 nt, Artificial Sequence; identical to SEQ ID NO: 172275
  derived and/or modified sequence opt4 from neuraminidase__InfluenzaA__AEA04022

SEQ ID NO: 172996 - RNA, 1410 nt, Artificial Sequence; identical to SEQ ID NO: 169119
  derived and/or modified sequence opt4 from neuraminidase__InfluenzaA__AEA04033

SEQ ID NO: 172997 - RNA, 1410 nt, Artificial Sequence; identical to SEQ ID NO: 169119
  derived and/or modified sequence opt4 from neuraminidase__InfluenzaA__AEA04044

SEQ ID NO: 172998 - RNA, 1410 nt, Artificial Sequence; identical to SEQ ID NO: 169119
  derived and/or modified sequence opt4 from neuraminidase__InfluenzaA__AEA04049

SEQ ID NO: 172999 - RNA, 1410 nt, Artificial Sequence; identical to SEQ ID NO: 169119
  derived and/or modified sequence opt4 from neuraminidase__InfluenzaA__AEA04059

SEQ ID NO: 173000 - RNA, 1410 nt, Artificial Sequence; identical to SEQ ID NO: 169119
  derived and/or modified sequence opt4 from neuraminidase__InfluenzaA__AEA04070

SEQ ID NO: 173001 - RNA, 1410 nt, Artificial Sequence; identical to SEQ ID NO: 172275
  derived and/or modified sequence opt4 from neuraminidase__InfluenzaA__AEA04081

SEQ ID NO: 173002 - RNA, 1410 nt, Artificial Sequence; identical to SEQ ID NO: 169119
  derived and/or modified sequence opt4 from neuraminidase__InfluenzaA__AEA04092

SEQ ID NO: 173003 - RNA, 1410 nt, Artificial Sequence; identical to SEQ ID NO: 169119
  derived and/or modified sequence opt4 from neuraminidase__InfluenzaA__AEA04103

SEQ ID NO: 173004 - RNA, 1410 nt, Artificial Sequence; identical to SEQ ID NO: 169119
  derived and/or modified sequence opt4 from neuraminidase__InfluenzaA__AEA04125

SEQ ID NO: 173005 - RNA, 1410 nt, Artificial Sequence; identical to SEQ ID NO: 169119
  derived and/or modified sequence opt4 from neuraminidase__InfluenzaA__AEA04133

SEQ ID NO: 173006 - RNA, 1410 nt, Artificial Sequence
  derived and/or modified sequence opt4 from neuraminidase__InfluenzaA__AEA04144
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucaucguguucugcggcaccagcggcaccuacggcaccggcagcuggcccgacggcgccgacaucaaccugaugcccaucuga

SEQ ID NO: 173007 - RNA, 1410 nt, Artificial Sequence; identical to SEQ ID NO: 169119
  derived and/or modified sequence opt4 from neuraminidase__InfluenzaA__AEA04155

SEQ ID NO: 173008 - RNA, 1410 nt, Artificial Sequence; identical to SEQ ID NO: 169119
  derived and/or modified sequence opt4 from neuraminidase__InfluenzaA__AEA04166

SEQ ID NO: 173009 - RNA, 1410 nt, Artificial Sequence
  derived and/or modified sequence opt4 from neuraminidase__InfluenzaA__AEA04177
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173010 - RNA, 1410 nt, Artificial Sequence; identical to SEQ ID NO: 169119
  derived and/or modified sequence opt4 from neuraminidase__InfluenzaA__AEA04188

SEQ ID NO: 173011 - RNA, 1410 nt, Artificial Sequence; identical to SEQ ID NO: 170112
  derived and/or modified sequence opt4 from neuraminidase__InfluenzaA__AEA04199

SEQ ID NO: 173012 - RNA, 1410 nt, Artificial Sequence; identical to SEQ ID NO: 169119
  derived and/or modified sequence opt4 from neuraminidase__InfluenzaA__AEA04210

SEQ ID NO: 173013 - RNA, 1410 nt, Artificial Sequence; identical to SEQ ID NO: 170112
  derived and/or modified sequence opt4 from neuraminidase__InfluenzaA__AEA04229

SEQ ID NO: 173014 - RNA, 1410 nt, Artificial Sequence; identical to SEQ ID NO: 170112
  derived and/or modified sequence opt4 from neuraminidase__InfluenzaA__AEA04239

SEQ ID NO: 173015 - RNA, 1410 nt, Artificial Sequence
  derived and/or modified sequence opt4 from neuraminidase__InfluenzaA__AEA04250
augaaccccaaccagaagaucaucaccaucggcagcgugagccugaccaucagcaccaucugcuucuucaugcagaccgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagugagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173016 - RNA, 1410 nt, Artificial Sequence; identical to SEQ ID NO: 170112
  derived and/or modified sequence opt4 from neuraminidase__InfluenzaA__AEA04260

SEQ ID NO: 173017 - RNA, 1410 nt, Artificial Sequence
  derived and/or modified sequence opt4 from neuraminidase__InfluenzaA__AEA04268
augaaccccaaccagaagaucaucaccaucggcagcgugagccugaccaucagcaccaucugccuguucaugcagaccgccauccugaucaccaccgugacccugcacuucaagcagugcgaguucaacagcccccccaacaaccaggccaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173018 - RNA, 1410 nt, Artificial Sequence; identical to SEQ ID NO: 170112
  derived and/or modified sequence opt4 from neuraminidase__InfluenzaA__AEA04276

SEQ ID NO: 173019 - RNA, 1410 nt, Artificial Sequence; identical to SEQ ID NO: 170112
  derived and/or modified sequence opt4 from neuraminidase__InfluenzaA__AEA04287

SEQ ID NO: 173020 - RNA, 1410 nt, Artificial Sequence; identical to SEQ ID NO: 170112
  derived and/or modified sequence opt4 from neuraminidase__InfluenzaA__AEA04298

SEQ ID NO: 173021 - RNA, 1410 nt, Artificial Sequence
  derived and/or modified sequence opt4 from neuraminidase__InfluenzaA__AEA04307
augaaccccaaccagaagaucaucaccaucggcagcgugagccugaccaucagcaccaucugcuucuucaugcagaccgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccgacgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173022 - RNA, 1395 nt, Artificial Sequence
  derived and/or modified sequence opt4 from neuraminidase__InfluenzaA__AEA04357
augaaccccaaccagaagaucaucaccaucggcagcaucugcaugguggugggcaucaucagccugauccugcagaucggcaacaucgugagcaucuggaucagccacagcauccagaccggcaaccagaaccacaccggcaccugcgaccagagcaucaucaccuacaagaacagcaccugggugaaccagaccuacgugaacgugguggccggcaaggacaccaccagcgugauccuggccggcaacagcagccugugccccaucagaggcugggccaucuacagcaaggacaacggcgugagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaaggagauccugagaacccaggagagcgagugcgugugcgugaacggcagcugcuucaccaucaugaccgacggccccagcggcggccccgccagcuacaagaucuucaagaucgagaagggcaaggugaccaagagcaucgagcuggacgcccccaacagccacuacgaggagugcagcugcuaccccgacaccagcaaggugaugugcgugugcagagacaacuggcacggcagcaacagacccugggugagcuucgaccagaaccuggacuaccagaugggcuacaucugcagcggcguguucggcgacaaccccagacccaaggacggcaagggcagcugcggccccguguacguggacggcgccaacggcgugaagggcuucagcuacaaguacggcaacggcguguggaucggcagaaccaagagcaucagcagcagacagggcuucgagaugaucugggaccccaacggcuggaccgagaccgacagcaacuucuucaccaagcaggacgugguggccgugaccgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 173023 - RNA, 1410 nt, Artificial Sequence; identical to SEQ ID NO: 168987
  derived and/or modified sequence opt4 from neuraminidase__InfluenzaA__AEA04368

SEQ ID NO: 173024 - RNA, 1410 nt, Artificial Sequence
  derived and/or modified sequence opt4 from neuraminidase__InfluenzaA__AEA04379
augaaccccaaccagaagaccaucaccaucggcagcgugagccugaccaucgagaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaagagcagagaccccaacaacgagagaggcaaccccggcgugaagggcugggccuucgacaacggcgacgacguguggaugggcagaaccaucagcaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 173025 - RNA, 1413 nt, Artificial Sequence; identical to SEQ ID NO: 172724
  derived and/or modified sequence opt4 from neuraminidase__InfluenzaA__AEA10295

SEQ ID NO: 173026 - RNA, 1410 nt, Artificial Sequence; identical to SEQ ID NO: 169258
  derived and/or modified sequence opt4 from neuraminidase__InfluenzaA__AEA10306

SEQ ID NO: 173027 - RNA, 1410 nt, Artificial Sequence; identical to SEQ ID NO: 172611
  derived and/or modified sequence opt4 from neuraminidase__InfluenzaA__AEA10316

SEQ ID NO: 173028 - RNA, 1410 nt, Artificial Sequence; identical to SEQ ID NO: 169258
  derived and/or modified sequence opt4 from neuraminidase__InfluenzaA__AEA10326

SEQ ID NO: 173029 - RNA, 1410 nt, Artificial Sequence; identical to SEQ ID NO: 170546
  derived and/or modified sequence opt4 from neuraminidase__InfluenzaA__AEA10335

SEQ ID NO: 173030 - RNA, 1410 nt, Artificial Sequence; identical to SEQ ID NO: 169258
  derived and/or modified sequence opt4 from neuraminidase__InfluenzaA__AEA10342

SEQ ID NO: 173031 - RNA, 1410 nt, Artificial Sequence
  derived and/or modified sequence opt4 from neuraminidase__InfluenzaA__AEA10352
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcaucaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcagccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173032 - RNA, 1410 nt, Artificial Sequence; identical to SEQ ID NO: 169258
  derived and/or modified sequence opt4 from neuraminidase__InfluenzaA__AEA48991

SEQ ID NO: 173033 - RNA, 1410 nt, Artificial Sequence; identical to SEQ ID NO: 171930
  derived and/or modified sequence opt4 from neuraminidase__InfluenzaA__AEA72707

SEQ ID NO: 173034 - RNA, 1410 nt, Artificial Sequence; identical to SEQ ID NO: 171930
  derived and/or modified sequence opt4 from neuraminidase__InfluenzaA__AEA72718

SEQ ID NO: 173035 - RNA, 1410 nt, Artificial Sequence; identical to SEQ ID NO: 171930
  derived and/or modified sequence opt4 from neuraminidase__InfluenzaA__AEA72729

SEQ ID NO: 173036 - RNA, 1410 nt, Artificial Sequence
  derived and/or modified sequence opt4 from neuraminidase__InfluenzaA__AEA72742
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173037 - RNA, 1410 nt, Artificial Sequence; identical to SEQ ID NO: 171533
  derived and/or modified sequence opt4 from neuraminidase__InfluenzaA__AEA72779

SEQ ID NO: 173038 - RNA, 1410 nt, Artificial Sequence
  derived and/or modified sequence opt4 from neuraminidase__InfluenzaA__AEA72789
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacgacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173039 - RNA, 1410 nt, Artificial Sequence; identical to SEQ ID NO: 171930
  derived and/or modified sequence opt4 from neuraminidase__InfluenzaA__AEA73291

SEQ ID NO: 173040 - RNA, 1410 nt, Artificial Sequence; identical to SEQ ID NO: 171930
  derived and/or modified sequence opt4 from neuraminidase__InfluenzaA__AEA73302

SEQ ID NO: 173041 - RNA, 1410 nt, Artificial Sequence; identical to SEQ ID NO: 171930
  derived and/or modified sequence opt4 from neuraminidase__InfluenzaA__AEA73313

SEQ ID NO: 173042 - RNA, 1410 nt, Artificial Sequence; identical to SEQ ID NO: 171930
  derived and/or modified sequence opt4 from neuraminidase__InfluenzaA__AEA73324

SEQ ID NO: 173043 - RNA, 1410 nt, Artificial Sequence; identical to SEQ ID NO: 171930
  derived and/or modified sequence opt4 from neuraminidase__InfluenzaA__AEA73335

SEQ ID NO: 173044 - RNA, 1410 nt, Artificial Sequence; identical to SEQ ID NO: 171930
  derived and/or modified sequence opt4 from neuraminidase__InfluenzaA__AEA73346

SEQ ID NO: 173045 - RNA, 1410 nt, Artificial Sequence; identical to SEQ ID NO: 171930
  derived and/or modified sequence opt4 from neuraminidase__InfluenzaA__AEA73357

SEQ ID NO: 173046 - RNA, 1410 nt, Artificial Sequence; identical to SEQ ID NO: 171930
  derived and/or modified sequence opt4 from neuraminidase__InfluenzaA__AEA73368

SEQ ID NO: 173047 - RNA, 1410 nt, Artificial Sequence; identical to SEQ ID NO: 171930
  derived and/or modified sequence opt4 from neuraminidase__InfluenzaA__AEA73379

SEQ ID NO: 173048 - RNA, 1410 nt, Artificial Sequence; identical to SEQ ID NO: 171930
  derived and/or modified sequence opt4 from neuraminidase__InfluenzaA__AEA73390

SEQ ID NO: 173049 - RNA, 1410 nt, Artificial Sequence; identical to SEQ ID NO: 171930
  derived and/or modified sequence opt4 from neuraminidase__InfluenzaA__AEA73401

SEQ ID NO: 173050 - RNA, 1410 nt, Artificial Sequence; identical to SEQ ID NO: 171930
  derived and/or modified sequence opt4 from neuraminidase__InfluenzaA__AEA73412

SEQ ID NO: 173051 - RNA, 1410 nt, Artificial Sequence; identical to SEQ ID NO: 171930
  derived and/or modified sequence opt4 from neuraminidase__InfluenzaA__AEA73423

SEQ ID NO: 173052 - RNA, 1410 nt, Artificial Sequence; identical to SEQ ID NO: 171930
  derived and/or modified sequence opt4 from neuraminidase__InfluenzaA__AEA73455

SEQ ID NO: 173053 - RNA, 1410 nt, Artificial Sequence; identical to SEQ ID NO: 171930
  derived and/or modified sequence opt4 from neuraminidase__InfluenzaA__AEA73466

SEQ ID NO: 173054 - RNA, 1410 nt, Artificial Sequence
  derived and/or modified sequence opt4 from neuraminidase__InfluenzaA__AEA73477
augaaccccaaccagaagaucaucaccaucggcagcgugagccugaccaucagcaccaucugcuucuucaugcagaucgccauccugaucaccaccgugacccugcacuucaagcaguacaaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccaaggugcuguggaccagcaacagcaucgugguguucugcggcaccagcggcaccuacggcaccggcagcuggcccgacggcgccgaccugaaccugaugcccaucuga

SEQ ID NO: 173055 - RNA, 1410 nt, Artificial Sequence; identical to SEQ ID NO: 171930
  derived and/or modified sequence opt4 from neuraminidase__InfluenzaA__AEA73488

SEQ ID NO: 173056 - RNA, 1410 nt, Artificial Sequence
  derived and/or modified sequence opt4 from neuraminidase__InfluenzaA__AEA73499
augaaccccaaccagaagaucaucaccaucggcagcgugagccugaccaucagcaccaucugcuucuucaugcagaucgccauccugaucaccaccgugacccugcacuucaagcaguacaaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccaccaucaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173057 - RNA, 1410 nt, Artificial Sequence; identical to SEQ ID NO: 171930
  derived and/or modified sequence opt4 from neuraminidase__InfluenzaA__AEA73510

SEQ ID NO: 173058 - RNA, 1410 nt, Artificial Sequence; identical to SEQ ID NO: 171930
  derived and/or modified sequence opt4 from neuraminidase__InfluenzaA__AEA73521

SEQ ID NO: 173059 - RNA, 1410 nt, Artificial Sequence; identical to SEQ ID NO: 171930
  derived and/or modified sequence opt4 from neuraminidase__InfluenzaA__AEA73532

SEQ ID NO: 173060 - RNA, 1410 nt, Artificial Sequence; identical to SEQ ID NO: 171930
  derived and/or modified sequence opt4 from neuraminidase__InfluenzaA__AEA73543

SEQ ID NO: 173061 - RNA, 1410 nt, Artificial Sequence; identical to SEQ ID NO: 171930
  derived and/or modified sequence opt4 from neuraminidase__InfluenzaA__AEA73554

SEQ ID NO: 173062 - RNA, 1410 nt, Artificial Sequence; identical to SEQ ID NO: 171930
  derived and/or modified sequence opt4 from neuraminidase__InfluenzaA__AEA73565

SEQ ID NO: 173063 - RNA, 1413 nt, Artificial Sequence; identical to SEQ ID NO: 169981
  derived and/or modified sequence opt4 from neuraminidase__InfluenzaA__AEA73576

SEQ ID NO: 173064 - RNA, 1413 nt, Artificial Sequence; identical to SEQ ID NO: 169981
  derived and/or modified sequence opt4 from neuraminidase__InfluenzaA__AEA73587

SEQ ID NO: 173065 - RNA, 1413 nt, Artificial Sequence; identical to SEQ ID NO: 172724
  derived and/or modified sequence opt4 from neuraminidase__InfluenzaA__AEA73598

SEQ ID NO: 173066 - RNA, 1413 nt, Artificial Sequence; identical to SEQ ID NO: 169981
  derived and/or modified sequence opt4 from neuraminidase__InfluenzaA__AEA73609

SEQ ID NO: 173067 - RNA, 1413 nt, Artificial Sequence; identical to SEQ ID NO: 169981
  derived and/or modified sequence opt4 from neuraminidase__InfluenzaA__AEA73620

SEQ ID NO: 173068 - RNA, 1413 nt, Artificial Sequence
  derived and/or modified sequence opt4 from neuraminidase__InfluenzaA__AEA73631
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaucaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173069 - RNA, 1413 nt, Artificial Sequence
  derived and/or modified sequence opt4 from neuraminidase__InfluenzaA__AEA73642
augaaccccaaccagagaaucaucaccaucggcagcaucagcaucgccaucggcaucaucagccugaugcugcagaucggcaacaucaucagcaucugggccagccacagcauccagaccggcagccagaacaacaccggcaucugcaagcagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggcugggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173070 - RNA, 1413 nt, Artificial Sequence; identical to SEQ ID NO: 169981
  derived and/or modified sequence opt4 from neuraminidase__InfluenzaA__AEA73653

SEQ ID NO: 173071 - RNA, 1413 nt, Artificial Sequence
  derived and/or modified sequence opt4 from neuraminidase__InfluenzaA__AEA73664
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccgugaacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 173072 - RNA, 1413 nt, Artificial Sequence
  derived and/or modified sequence opt4 from neuraminidase__InfluenzaA__AEA73675
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggaucgagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173073 - RNA, 1413 nt, Artificial Sequence; identical to SEQ ID NO: 172724
  derived and/or modified sequence opt4 from neuraminidase__InfluenzaA__AEA73686

SEQ ID NO: 173074 - RNA, 1413 nt, Artificial Sequence
  derived and/or modified sequence opt4 from neuraminidase__InfluenzaA__AEA73697
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacaucguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcguggagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccgugaacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173075 - RNA, 1413 nt, Artificial Sequence; identical to SEQ ID NO: 172725
  derived and/or modified sequence opt4 from neuraminidase__InfluenzaA__AEA73708

SEQ ID NO: 173076 - RNA, 1413 nt, Artificial Sequence; identical to SEQ ID NO: 169981
  derived and/or modified sequence opt4 from neuraminidase__InfluenzaA__AEA73719

SEQ ID NO: 173077 - RNA, 1413 nt, Artificial Sequence; identical to SEQ ID NO: 169981
  derived and/or modified sequence opt4 from neuraminidase__InfluenzaA__AEA73730

SEQ ID NO: 173078 - RNA, 1413 nt, Artificial Sequence; identical to SEQ ID NO: 169981
  derived and/or modified sequence opt4 from neuraminidase__InfluenzaA__AEA73741

SEQ ID NO: 173079 - RNA, 1413 nt, Artificial Sequence; identical to SEQ ID NO: 169981
  derived and/or modified sequence opt4 from neuraminidase__InfluenzaA__AEA73752

SEQ ID NO: 173080 - RNA, 1413 nt, Artificial Sequence; identical to SEQ ID NO: 172724
  derived and/or modified sequence opt4 from neuraminidase__InfluenzaA__AEA73763

SEQ ID NO: 173081 - RNA, 1410 nt, Artificial Sequence; identical to SEQ ID NO: 169258
  derived and/or modified sequence opt4 from neuraminidase__InfluenzaA__AEA73774

SEQ ID NO: 173082 - RNA, 1410 nt, Artificial Sequence; identical to SEQ ID NO: 169258
  derived and/or modified sequence opt4 from neuraminidase__InfluenzaA__AEA73784

SEQ ID NO: 173083 - RNA, 1410 nt, Artificial Sequence; identical to SEQ ID NO: 169258
  derived and/or modified sequence opt4 from neuraminidase__InfluenzaA__AEA73794

SEQ ID NO: 173084 - RNA, 1410 nt, Artificial Sequence; identical to SEQ ID NO: 169258
  derived and/or modified sequence opt4 from neuraminidase__InfluenzaA__AEA73804

SEQ ID NO: 173085 - RNA, 1410 nt, Artificial Sequence; identical to SEQ ID NO: 169258
  derived and/or modified sequence opt4 from neuraminidase__InfluenzaA__AEA73814

SEQ ID NO: 173086 - RNA, 1410 nt, Artificial Sequence; identical to SEQ ID NO: 169258
  derived and/or modified sequence opt4 from neuraminidase__InfluenzaA__AEA73824

SEQ ID NO: 173087 - RNA, 1410 nt, Artificial Sequence
  derived and/or modified sequence opt4 from neuraminidase__InfluenzaA__AEA73834
augaaccccaaccagaagaucaucaccaucggcagcaucugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggaagaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173088 - RNA, 1410 nt, Artificial Sequence; identical to SEQ ID NO: 172620
  derived and/or modified sequence opt4 from neuraminidase__InfluenzaA__AEA73844

SEQ ID NO: 173089 - RNA, 1410 nt, Artificial Sequence; identical to SEQ ID NO: 169258
  derived and/or modified sequence opt4 from neuraminidase__InfluenzaA__AEA73854

SEQ ID NO: 173090 - RNA, 1410 nt, Artificial Sequence; identical to SEQ ID NO: 169258
  derived and/or modified sequence opt4 from neuraminidase__InfluenzaA__AEA73864

SEQ ID NO: 173091 - RNA, 1410 nt, Artificial Sequence; identical to SEQ ID NO: 171039
  derived and/or modified sequence opt4 from neuraminidase__InfluenzaA__AEA73874

SEQ ID NO: 173092 - RNA, 1410 nt, Artificial Sequence; identical to SEQ ID NO: 171039
  derived and/or modified sequence opt4 from neuraminidase__InfluenzaA__AEA73884

SEQ ID NO: 173093 - RNA, 1410 nt, Artificial Sequence; identical to SEQ ID NO: 172620
  derived and/or modified sequence opt4 from neuraminidase__InfluenzaA__AEA73894

SEQ ID NO: 173094 - RNA, 1410 nt, Artificial Sequence
  derived and/or modified sequence opt4 from neuraminidase__InfluenzaA__AEA73904
augaaccccaaccagaagaucaucaccaucggcagcgugugcaugaccaucggcauggccaaccuggugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaagaccaucuggaccagcggcagcagcaucagcuucugcggcgugaacagcgacaccgugggcuggagcuggcccgacggcgccgagcugcccuucaccaucgacaaguga

SEQ ID NO: 173095 - RNA, 1410 nt, Artificial Sequence; identical to SEQ ID NO: 169258
  derived and/or modified sequence opt4 from neuraminidase__InfluenzaA__AEA73914

SEQ ID NO: 173096 - RNA, 1410 nt, Artificial Sequence; identical to SEQ ID NO: 171039
  derived and/or modified sequence opt4 from neuraminidase__InfluenzaA__AEA73924

SEQ ID NO: 173097 - RNA, 1410 nt, Artificial Sequence; identical to SEQ ID NO: 172697
  derived and/or modified sequence opt4 from neuraminidase__InfluenzaA__AEA73934

SEQ ID NO: 173098 - RNA, 1410 nt, Artificial Sequence
  derived and/or modified sequence opt4 from neuraminidase__InfluenzaA__AEA73944
augaaccccaaccagaagaucaucaccaucggcagcgugugcaugaccaucggcauggccaaccugauccugcaggugggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173099 - RNA, 1410 nt, Artificial Sequence; identical to SEQ ID NO: 169258
  derived and/or modified sequence opt4 from neuraminidase__InfluenzaA__AEA73954

SEQ ID NO: 173100 - RNA, 1410 nt, Artificial Sequence; identical to SEQ ID NO: 169258
  derived and/or modified sequence opt4 from neuraminidase__InfluenzaA__AEA73964

SEQ ID NO: 173101 - RNA, 1410 nt, Artificial Sequence
  derived and/or modified sequence opt4 from neuraminidase__InfluenzaA__AEA73974
augaaccccaaccagaagaucaucaccaucggcagcgugugcaugaccaucggcauggccaaccugauccugcagaucggcaacaucaucagcaucuggaucagccacagcauccagcacggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173102 - RNA, 1410 nt, Artificial Sequence; identical to SEQ ID NO: 169258
  derived and/or modified sequence opt4 from neuraminidase__InfluenzaA__AEA73984

SEQ ID NO: 173103 - RNA, 1410 nt, Artificial Sequence; identical to SEQ ID NO: 170609
  derived and/or modified sequence opt4 from neuraminidase__InfluenzaA__AEA73994

SEQ ID NO: 173104 - RNA, 1410 nt, Artificial Sequence
  derived and/or modified sequence opt4 from neuraminidase__InfluenzaA__AEA74004
augaaccccaacaagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173105 - RNA, 1410 nt, Artificial Sequence; identical to SEQ ID NO: 170435
  derived and/or modified sequence opt4 from neuraminidase__InfluenzaA__AEA74014

SEQ ID NO: 173106 - RNA, 1410 nt, Artificial Sequence; identical to SEQ ID NO: 170435
  derived and/or modified sequence opt4 from neuraminidase__InfluenzaA__AEA74024

SEQ ID NO: 173107 - RNA, 1410 nt, Artificial Sequence; identical to SEQ ID NO: 169258
  derived and/or modified sequence opt4 from neuraminidase__InfluenzaA__AEA74032

SEQ ID NO: 173108 - RNA, 1410 nt, Artificial Sequence; identical to SEQ ID NO: 169258
  derived and/or modified sequence opt4 from neuraminidase__InfluenzaA__AEA74034

SEQ ID NO: 173109 - RNA, 1410 nt, Artificial Sequence
  derived and/or modified sequence opt4 from neuraminidase__InfluenzaA__AEA77302
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaagugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccaagaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173110 - RNA, 1410 nt, Artificial Sequence; identical to SEQ ID NO: 172777
  derived and/or modified sequence opt4 from neuraminidase__InfluenzaA__AEB21318

SEQ ID NO: 173111 - RNA, 1410 nt, Artificial Sequence
  derived and/or modified sequence opt4 from neuraminidase__InfluenzaA__AEB21328
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcuucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaugagcuucugcggcgugaacagcgacaccgugggcuggagcuggcccgacggcgccgagcugcccuucaccaucgacaaguga

SEQ ID NO: 173112 - RNA, 1410 nt, Artificial Sequence; identical to SEQ ID NO: 172777
  derived and/or modified sequence opt4 from neuraminidase__InfluenzaA__AEB21340

SEQ ID NO: 173113 - RNA, 1410 nt, Artificial Sequence
  derived and/or modified sequence opt4 from neuraminidase__InfluenzaA__AEB21350
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccccagcgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaucagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173114 - RNA, 1410 nt, Artificial Sequence; identical to SEQ ID NO: 172777
  derived and/or modified sequence opt4 from neuraminidase__InfluenzaA__AEB21360

SEQ ID NO: 173115 - RNA, 1410 nt, Artificial Sequence; identical to SEQ ID NO: 170125
  derived and/or modified sequence opt4 from neuraminidase__InfluenzaA__AEB40209

SEQ ID NO: 173116 - RNA, 1410 nt, Artificial Sequence; identical to SEQ ID NO: 169119
  derived and/or modified sequence opt4 from neuraminidase__InfluenzaA__AEB66898

SEQ ID NO: 173117 - RNA, 1413 nt, Artificial Sequence
  derived and/or modified sequence opt4 from neuraminidase__InfluenzaA__AEB71103
augaaccccaaccagaagaucaucaccaucggcagcgugagccugggccuggugguguucaacgugcugcugcacguggugagcaucaucgugaccgugguggugcugggcaacgacggcggcaacggcaucugcaacggcaccguggugaaggaguacaacgagaccgugagaaucgagagagugauccaguggcacaacaccagcgugguggaguacauccccuaccugaacggcggcaccuacaccaacaacaccgagagcgugugcgacgugaagggcuucgcccccuucagcaaggacaacggcgugagaaucggcagcagaggccacguguucgugaucagagagcccuucgugagcugcagccccagagagugcagaaccuucuuccugacccagggcagccugcugaacgacaagcacagcaacggcaccgugaaggacagaagccccuucaagacccugaugagcguggaggugggccagagccccaacguguaccaggccagauucgaggccguggccuggagcgccaccgccugccacgacggcaagaaguggaugaccaucggcgugaccggccccgacagcaaggccguggccguggugcacuacggcggcgugcccaccgacaucaucaacagcugggccggcgacauccugagaacccaggagagcagcugcaccugcauccagggcgacugcuacugggugaugaccgacggccccgccaacagacaggcccaguacagaaucuacaagagcaaccagggcaagaucaucggccagauggacaucaacuucaacggcggccacaucgaggagugcagcugcuaccccaacgacggcaagguggagugcgugugcagagacaacuggaccggcaccaacagacccgugcuggugaucagccccgaccugagcuacaaggugggcuaccugugcgccggccugcccagcgacacccccagaggcgaggacgcccaguucagcggcagcugcaccagccccgugggcggccagggcuacggcgugaagggcuucggcuucagacagggcaacgacguguggaugggcagaaccaucagcagaaccagcagaagcggcuucgaggugaucagagugaagaacggcuggacccagaccagcaaggagcagaucagaaagcagguggugguggacaaccugaacuggagcggcuacagcggcagcuucacccugcccaucgagcugagcggcaagagcugccuggugcccugcuucuggguggagaccaucagaggcaagcccgaggagaagaccaucuggaccagcagcagcagcaucgugaugugcggcguggacuacgagguggccgacuggagcuggcacgacggcgccauccugcccuucgacaucgacaagauguga

SEQ ID NO: 173118 - RNA, 1413 nt, Artificial Sequence; identical to SEQ ID NO: 171450
  derived and/or modified sequence opt4 from neuraminidase__InfluenzaA__AEB71899

SEQ ID NO: 173119 - RNA, 1410 nt, Artificial Sequence
  derived and/or modified sequence opt4 from neuraminidase__InfluenzaA__AEB71910
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccuacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173120 - RNA, 1410 nt, Artificial Sequence; identical to SEQ ID NO: 169258
  derived and/or modified sequence opt4 from neuraminidase__InfluenzaA__AEB71919

SEQ ID NO: 173121 - RNA, 1410 nt, Artificial Sequence; identical to SEQ ID NO: 171004
  derived and/or modified sequence opt4 from neuraminidase__InfluenzaA__AEB71928

SEQ ID NO: 173122 - RNA, 1410 nt, Artificial Sequence
  derived and/or modified sequence opt4 from neuraminidase__InfluenzaA__AEB71939
augaaccccaaccagaagaucaucaccaucggcagcgugagccugaccaucagcgccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173123 - RNA, 1410 nt, Artificial Sequence
  derived and/or modified sequence opt4 from neuraminidase__InfluenzaA__AEB71950
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcgaccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173124 - RNA, 1413 nt, Artificial Sequence; identical to SEQ ID NO: 172457
  derived and/or modified sequence opt4 from neuraminidase__InfluenzaA__AEB71961

SEQ ID NO: 173125 - RNA, 1410 nt, Artificial Sequence
  derived and/or modified sequence opt4 from neuraminidase__InfluenzaA__AEB71972
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgugaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173126 - RNA, 1410 nt, Artificial Sequence
  derived and/or modified sequence opt4 from neuraminidase__InfluenzaA__AEB71983
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaagaaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173127 - RNA, 1413 nt, Artificial Sequence
  derived and/or modified sequence opt4 from neuraminidase__InfluenzaA__AEB71995
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacaucaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccgugaacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggagugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173128 - RNA, 1413 nt, Artificial Sequence; identical to SEQ ID NO: 172725
  derived and/or modified sequence opt4 from neuraminidase__InfluenzaA__AEC13316

SEQ ID NO: 173129 - RNA, 1410 nt, Artificial Sequence; identical to SEQ ID NO: 169258
  derived and/or modified sequence opt4 from neuraminidase__InfluenzaA__AEC53262

SEQ ID NO: 173130 - RNA, 1410 nt, Artificial Sequence; identical to SEQ ID NO: 169258
  derived and/or modified sequence opt4 from neuraminidase__InfluenzaA__AEC53272

SEQ ID NO: 173131 - RNA, 1410 nt, Artificial Sequence; identical to SEQ ID NO: 169258
  derived and/or modified sequence opt4 from neuraminidase__InfluenzaA__AEC53282

SEQ ID NO: 173132 - RNA, 1410 nt, Artificial Sequence; identical to SEQ ID NO: 169258
  derived and/or modified sequence opt4 from neuraminidase__InfluenzaA__AEC53292

SEQ ID NO: 173133 - RNA, 1410 nt, Artificial Sequence
  derived and/or modified sequence opt4 from neuraminidase__InfluenzaA__AEC53302
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaucaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173134 - RNA, 1410 nt, Artificial Sequence; identical to SEQ ID NO: 169258
  derived and/or modified sequence opt4 from neuraminidase__InfluenzaA__AEC53350

SEQ ID NO: 173135 - RNA, 1410 nt, Artificial Sequence; identical to SEQ ID NO: 169966
  derived and/or modified sequence opt4 from neuraminidase__InfluenzaA__AEC53407

SEQ ID NO: 173136 - RNA, 1410 nt, Artificial Sequence; identical to SEQ ID NO: 169258
  derived and/or modified sequence opt4 from neuraminidase__InfluenzaA__AEC53427

SEQ ID NO: 173137 - RNA, 1410 nt, Artificial Sequence; identical to SEQ ID NO: 170084
  derived and/or modified sequence opt4 from neuraminidase__InfluenzaA__AED99967

SEQ ID NO: 173138 - RNA, 1410 nt, Artificial Sequence; identical to SEQ ID NO: 169248
  derived and/or modified sequence opt4 from neuraminidase__InfluenzaA__AEE27161

SEQ ID NO: 173139 - RNA, 1410 nt, Artificial Sequence; identical to SEQ ID NO: 169258
  derived and/or modified sequence opt4 from neuraminidase__InfluenzaA__AEE27170

SEQ ID NO: 173140 - RNA, 1410 nt, Artificial Sequence; identical to SEQ ID NO: 169248
  derived and/or modified sequence opt4 from neuraminidase__InfluenzaA__AEE27180

SEQ ID NO: 173141 - RNA, 1410 nt, Artificial Sequence
  derived and/or modified sequence opt4 from neuraminidase__InfluenzaA__AEE27190
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcgugaucaccgacaccaucaagagcuggagaaacaacauccugagaacccaggagagcgagugcgccugcgugaacggcagcugcuucaccgugaugaccgacggccccagcaacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173142 - RNA, 1410 nt, Artificial Sequence; identical to SEQ ID NO: 170481
  derived and/or modified sequence opt4 from neuraminidase__InfluenzaA__AEE27200

SEQ ID NO: 173143 - RNA, 1410 nt, Artificial Sequence; identical to SEQ ID NO: 172317
  derived and/or modified sequence opt4 from neuraminidase__InfluenzaA__AEG64755

SEQ ID NO: 173144 - RNA, 1362 nt, Artificial Sequence
  derived and/or modified sequence opt4 from neuraminidase__InfluenzaA__AEG64765
augaaccccaaccagaagaucaucaccaucggcagcaucugcaugguggugggcaucaucagccugauccugcagaucggcaacaucaucagcaucuggaucagccacagcauccagaccggcaaccagaaccacaccggcaucugcaaccagggcaucaucaccuacaacgugguggccggccaggacagcaccagcgugauccugaccggcaacagcagccugugccccaucagaggcugggccauccacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcaccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaccggcagcugcggccccgugagcgccgacggcgccaacggcgugaagggcuucagcuacagauacggcaacggcguguggaucggcagaaccaagagcgacagcagcagacacggcuucgagaugaucugggaccccaacggcuggaccgagaccgacagcagauucagcgugagacaggacgugguggccaugaccgacagaagcggcuacagcggcagcuucgugcagcaccccgagcugaccggccuggacugcaugagacccugcuucuggguggagcugaucagaggcagacccgaggagaagaccaucuggaccagcggcagcaucaucagcuucugcggcgugaacagcgacaccguggacuggagcuggcccgacggcgccgagcugcccuucaccaucgacaaguga

SEQ ID NO: 173145 - RNA, 1410 nt, Artificial Sequence
  derived and/or modified sequence opt4 from neuraminidase__InfluenzaA__AEG64787
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacagacugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacgacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173146 - RNA, 1410 nt, Artificial Sequence
  derived and/or modified sequence opt4 from neuraminidase__InfluenzaA__AEG64837
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagccugaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173147 - RNA, 1410 nt, Artificial Sequence
  derived and/or modified sequence opt4 from neuraminidase__InfluenzaA__AEG64848
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggcugaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacaagcaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173148 - RNA, 1410 nt, Artificial Sequence; identical to SEQ ID NO: 166753
  derived and/or modified sequence opt4 from neuraminidase__InfluenzaA__AEG64859

SEQ ID NO: 173149 - RNA, 1410 nt, Artificial Sequence; identical to SEQ ID NO: 166581
  derived and/or modified sequence opt4 from neuraminidase__InfluenzaA__AEG64870

SEQ ID NO: 173150 - RNA, 1410 nt, Artificial Sequence; identical to SEQ ID NO: 166773
  derived and/or modified sequence opt4 from neuraminidase__InfluenzaA__AEG64881

SEQ ID NO: 173151 - RNA, 1410 nt, Artificial Sequence; identical to SEQ ID NO: 166581
  derived and/or modified sequence opt4 from neuraminidase__InfluenzaA__AEG64892

SEQ ID NO: 173152 - RNA, 1410 nt, Artificial Sequence; identical to SEQ ID NO: 166657
  derived and/or modified sequence opt4 from neuraminidase__InfluenzaA__AEG64914

SEQ ID NO: 173153 - RNA, 1410 nt, Artificial Sequence; identical to SEQ ID NO: 166657
  derived and/or modified sequence opt4 from neuraminidase__InfluenzaA__AEG64925

SEQ ID NO: 173154 - RNA, 1410 nt, Artificial Sequence
  derived and/or modified sequence opt4 from neuraminidase__InfluenzaA__AEG64936
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgaggacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 173155 - RNA, 1410 nt, Artificial Sequence; identical to SEQ ID NO: 166670
  derived and/or modified sequence opt4 from neuraminidase__InfluenzaA__AEG64947

SEQ ID NO: 173156 - RNA, 1410 nt, Artificial Sequence; identical to SEQ ID NO: 166657
  derived and/or modified sequence opt4 from neuraminidase__InfluenzaA__AEG64958

SEQ ID NO: 173157 - RNA, 1410 nt, Artificial Sequence; identical to SEQ ID NO: 166657
  derived and/or modified sequence opt4 from neuraminidase__InfluenzaA__AEG64969

SEQ ID NO: 173158 - RNA, 1410 nt, Artificial Sequence; identical to SEQ ID NO: 166657
  derived and/or modified sequence opt4 from neuraminidase__InfluenzaA__AEG64980

SEQ ID NO: 173159 - RNA, 1410 nt, Artificial Sequence
  derived and/or modified sequence opt4 from neuraminidase__InfluenzaA__AEG64991
augaaccccaaccagaagaucaucaccaucggcagcgugagccugaccaucagcaccaucugcuucuucaugcagaucgccauccugaucaccaccgugacccugcacuucaagcaguacgagagcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173160 - RNA, 1410 nt, Artificial Sequence; identical to SEQ ID NO: 166847
  derived and/or modified sequence opt4 from neuraminidase__InfluenzaA__AEG65002

SEQ ID NO: 173161 - RNA, 1410 nt, Artificial Sequence
  derived and/or modified sequence opt4 from neuraminidase__InfluenzaA__AEG65013
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173162 - RNA, 1410 nt, Artificial Sequence
  derived and/or modified sequence opt4 from neuraminidase__InfluenzaA__AEG65024
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccacgugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173163 - RNA, 1410 nt, Artificial Sequence
  derived and/or modified sequence opt4 from neuraminidase__InfluenzaA__AEG65035
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggaggugugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccuggacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 173164 - RNA, 1410 nt, Artificial Sequence; identical to SEQ ID NO: 167232
  derived and/or modified sequence opt4 from neuraminidase__InfluenzaA__AEG65057

SEQ ID NO: 173165 - RNA, 1410 nt, Artificial Sequence; identical to SEQ ID NO: 168227
  derived and/or modified sequence opt4 from neuraminidase__InfluenzaA__AEG65068

SEQ ID NO: 173166 - RNA, 1410 nt, Artificial Sequence
  derived and/or modified sequence opt4 from neuraminidase__InfluenzaA__AEG65079
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgccaagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173167 - RNA, 1410 nt, Artificial Sequence
  derived and/or modified sequence opt4 from neuraminidase__InfluenzaA__AEG65090
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucagccugaugcccaucuga

SEQ ID NO: 173168 - RNA, 1410 nt, Artificial Sequence
  derived and/or modified sequence opt4 from neuraminidase__InfluenzaA__AEG65101
augaaccccaaccagaagaucaucaccaucggcagcgugagccugaccaucagcaccaucugcuucuucaugcagaucgccauccugaucaccaccgugacccugcacuucaagcaguacgaguucaacagcccccccgacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173169 - RNA, 1410 nt, Artificial Sequence
  derived and/or modified sequence opt4 from neuraminidase__InfluenzaA__AEG65123
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaccaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 173170 - RNA, 1410 nt, Artificial Sequence; identical to SEQ ID NO: 168227
  derived and/or modified sequence opt4 from neuraminidase__InfluenzaA__AEG65134

SEQ ID NO: 173171 - RNA, 1410 nt, Artificial Sequence
  derived and/or modified sequence opt4 from neuraminidase__InfluenzaA__AEG65145
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcaacagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 173172 - RNA, 1410 nt, Artificial Sequence
  derived and/or modified sequence opt4 from neuraminidase__InfluenzaA__AEG65156
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 173173 - RNA, 1410 nt, Artificial Sequence
  derived and/or modified sequence opt4 from neuraminidase__InfluenzaA__AEG65167
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgccagacacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 173174 - RNA, 1410 nt, Artificial Sequence
  derived and/or modified sequence opt4 from neuraminidase__InfluenzaA__AEG65178
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 173175 - RNA, 1410 nt, Artificial Sequence
  derived and/or modified sequence opt4 from neuraminidase__InfluenzaA__AEG65189
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaacgacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173176 - RNA, 1410 nt, Artificial Sequence
  derived and/or modified sequence opt4 from neuraminidase__InfluenzaA__AEG65200
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggaggugcugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173177 - RNA, 1410 nt, Artificial Sequence; identical to SEQ ID NO: 167232
  derived and/or modified sequence opt4 from neuraminidase__InfluenzaA__AEG65211

SEQ ID NO: 173178 - RNA, 1410 nt, Artificial Sequence; identical to SEQ ID NO: 167234
  derived and/or modified sequence opt4 from neuraminidase__InfluenzaA__AEG65222

SEQ ID NO: 173179 - RNA, 1410 nt, Artificial Sequence
  derived and/or modified sequence opt4 from neuraminidase__InfluenzaA__AEG65233
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucaucgacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173180 - RNA, 1410 nt, Artificial Sequence
  derived and/or modified sequence opt4 from neuraminidase__InfluenzaA__AEG65244
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcacccagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgccagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 173181 - RNA, 1410 nt, Artificial Sequence; identical to SEQ ID NO: 167234
  derived and/or modified sequence opt4 from neuraminidase__InfluenzaA__AEG65255

SEQ ID NO: 173182 - RNA, 1410 nt, Artificial Sequence; identical to SEQ ID NO: 167111
  derived and/or modified sequence opt4 from neuraminidase__InfluenzaA__AEG65266

SEQ ID NO: 173183 - RNA, 1410 nt, Artificial Sequence; identical to SEQ ID NO: 167111
  derived and/or modified sequence opt4 from neuraminidase__InfluenzaA__AEG65277

SEQ ID NO: 173184 - RNA, 1410 nt, Artificial Sequence
  derived and/or modified sequence opt4 from neuraminidase__InfluenzaA__AEG65288
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacaacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 173185 - RNA, 1410 nt, Artificial Sequence; identical to SEQ ID NO: 167111
  derived and/or modified sequence opt4 from neuraminidase__InfluenzaA__AEG65299

SEQ ID NO: 173186 - RNA, 1410 nt, Artificial Sequence; identical to SEQ ID NO: 167234
  derived and/or modified sequence opt4 from neuraminidase__InfluenzaA__AEG65310

SEQ ID NO: 173187 - RNA, 1410 nt, Artificial Sequence; identical to SEQ ID NO: 167234
  derived and/or modified sequence opt4 from neuraminidase__InfluenzaA__AEG65321

SEQ ID NO: 173188 - RNA, 1410 nt, Artificial Sequence; identical to SEQ ID NO: 167234
  derived and/or modified sequence opt4 from neuraminidase__InfluenzaA__AEG65332

SEQ ID NO: 173189 - RNA, 1410 nt, Artificial Sequence; identical to SEQ ID NO: 167234
  derived and/or modified sequence opt4 from neuraminidase__InfluenzaA__AEG65354

SEQ ID NO: 173190 - RNA, 1410 nt, Artificial Sequence; identical to SEQ ID NO: 167234
  derived and/or modified sequence opt4 from neuraminidase__InfluenzaA__AEG65365

SEQ ID NO: 173191 - RNA, 1410 nt, Artificial Sequence
  derived and/or modified sequence opt4 from neuraminidase__InfluenzaA__AEG65376
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcacccagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 173192 - RNA, 1410 nt, Artificial Sequence; identical to SEQ ID NO: 167111
  derived and/or modified sequence opt4 from neuraminidase__InfluenzaA__AEG65387

SEQ ID NO: 173193 - RNA, 1410 nt, Artificial Sequence; identical to SEQ ID NO: 167111
  derived and/or modified sequence opt4 from neuraminidase__InfluenzaA__AEG65398

SEQ ID NO: 173194 - RNA, 1410 nt, Artificial Sequence; identical to SEQ ID NO: 167111
  derived and/or modified sequence opt4 from neuraminidase__InfluenzaA__AEG65409

SEQ ID NO: 173195 - RNA, 1410 nt, Artificial Sequence; identical to SEQ ID NO: 167111
  derived and/or modified sequence opt4 from neuraminidase__InfluenzaA__AEG65420

SEQ ID NO: 173196 - RNA, 1410 nt, Artificial Sequence; identical to SEQ ID NO: 167111
  derived and/or modified sequence opt4 from neuraminidase__InfluenzaA__AEG65431

SEQ ID NO: 173197 - RNA, 1410 nt, Artificial Sequence; identical to SEQ ID NO: 167232
  derived and/or modified sequence opt4 from neuraminidase__InfluenzaA__AEG65442

SEQ ID NO: 173198 - RNA, 1410 nt, Artificial Sequence; identical to SEQ ID NO: 167234
  derived and/or modified sequence opt4 from neuraminidase__InfluenzaA__AEG65453

SEQ ID NO: 173199 - RNA, 1410 nt, Artificial Sequence; identical to SEQ ID NO: 167234
  derived and/or modified sequence opt4 from neuraminidase__InfluenzaA__AEG65464

SEQ ID NO: 173200 - RNA, 1410 nt, Artificial Sequence; identical to SEQ ID NO: 167234
  derived and/or modified sequence opt4 from neuraminidase__InfluenzaA__AEG65475

SEQ ID NO: 173201 - RNA, 1410 nt, Artificial Sequence
  derived and/or modified sequence opt4 from neuraminidase__InfluenzaA__AEG65486
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgagcacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173202 - RNA, 1410 nt, Artificial Sequence; identical to SEQ ID NO: 167234
  derived and/or modified sequence opt4 from neuraminidase__InfluenzaA__AEG65497

SEQ ID NO: 173203 - RNA, 1410 nt, Artificial Sequence; identical to SEQ ID NO: 167234
  derived and/or modified sequence opt4 from neuraminidase__InfluenzaA__AEG65508

SEQ ID NO: 173204 - RNA, 1410 nt, Artificial Sequence; identical to SEQ ID NO: 167234
  derived and/or modified sequence opt4 from neuraminidase__InfluenzaA__AEG65519

SEQ ID NO: 173205 - RNA, 1410 nt, Artificial Sequence; identical to SEQ ID NO: 167234
  derived and/or modified sequence opt4 from neuraminidase__InfluenzaA__AEG65530

SEQ ID NO: 173206 - RNA, 1410 nt, Artificial Sequence; identical to SEQ ID NO: 167234
  derived and/or modified sequence opt4 from neuraminidase__InfluenzaA__AEG65541

SEQ ID NO: 173207 - RNA, 1410 nt, Artificial Sequence
  derived and/or modified sequence opt4 from neuraminidase__InfluenzaA__AEG65563
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacagaugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173208 - RNA, 1410 nt, Artificial Sequence
  derived and/or modified sequence opt4 from neuraminidase__InfluenzaA__AEG65574
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaagcuggagcaagccccagugcgacaucaccggcuucgcccccuucagcaaggacaacagcaucagacugagcgccggcggcgacaucugggugaccagagagcccuacgugagcugcgaccccgacagaugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173209 - RNA, 1410 nt, Artificial Sequence; identical to SEQ ID NO: 173207
  derived and/or modified sequence opt4 from neuraminidase__InfluenzaA__AEG65585

SEQ ID NO: 173210 - RNA, 1410 nt, Artificial Sequence; identical to SEQ ID NO: 173207
  derived and/or modified sequence opt4 from neuraminidase__InfluenzaA__AEG65596

SEQ ID NO: 173211 - RNA, 1410 nt, Artificial Sequence
  derived and/or modified sequence opt4 from neuraminidase__InfluenzaA__AEG65607
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgccagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173212 - RNA, 1410 nt, Artificial Sequence
  derived and/or modified sequence opt4 from neuraminidase__InfluenzaA__AEG65629
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacgacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaucgaggugcuguggaccagcaacagcaucgugguguucugcggcaccagcggcaccuacggcaccggcagcuggcccgacggcgccgacaucaaccugaugcccaucuga

SEQ ID NO: 173213 - RNA, 1410 nt, Artificial Sequence; identical to SEQ ID NO: 173212
  derived and/or modified sequence opt4 from neuraminidase__InfluenzaA__AEG65640

SEQ ID NO: 173214 - RNA, 1410 nt, Artificial Sequence; identical to SEQ ID NO: 166655
  derived and/or modified sequence opt4 from neuraminidase__InfluenzaA__AEG65651

SEQ ID NO: 173215 - RNA, 1410 nt, Artificial Sequence; identical to SEQ ID NO: 167234
  derived and/or modified sequence opt4 from neuraminidase__InfluenzaA__AEG65662

SEQ ID NO: 173216 - RNA, 1410 nt, Artificial Sequence; identical to SEQ ID NO: 167234
  derived and/or modified sequence opt4 from neuraminidase__InfluenzaA__AEG65673

SEQ ID NO: 173217 - RNA, 1410 nt, Artificial Sequence; identical to SEQ ID NO: 167234
  derived and/or modified sequence opt4 from neuraminidase__InfluenzaA__AEG65684

SEQ ID NO: 173218 - RNA, 1410 nt, Artificial Sequence; identical to SEQ ID NO: 173191
  derived and/or modified sequence opt4 from neuraminidase__InfluenzaA__AEG65695

SEQ ID NO: 173219 - RNA, 1410 nt, Artificial Sequence
  derived and/or modified sequence opt4 from neuraminidase__InfluenzaA__AEG65706
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 173220 - RNA, 1410 nt, Artificial Sequence
  derived and/or modified sequence opt4 from neuraminidase__InfluenzaA__AEG65728
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgagaucaaccugaugcccaucuga

SEQ ID NO: 173221 - RNA, 1410 nt, Artificial Sequence
  derived and/or modified sequence opt4 from neuraminidase__InfluenzaA__AEG65739
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcccugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173222 - RNA, 1410 nt, Artificial Sequence; identical to SEQ ID NO: 169084
  derived and/or modified sequence opt4 from neuraminidase__InfluenzaA__AEG65750

SEQ ID NO: 173223 - RNA, 1410 nt, Artificial Sequence; identical to SEQ ID NO: 173220
  derived and/or modified sequence opt4 from neuraminidase__InfluenzaA__AEG65761

SEQ ID NO: 173224 - RNA, 1410 nt, Artificial Sequence
  derived and/or modified sequence opt4 from neuraminidase__InfluenzaA__AEG65772
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173225 - RNA, 1410 nt, Artificial Sequence; identical to SEQ ID NO: 172038
  derived and/or modified sequence opt4 from neuraminidase__InfluenzaA__AEG65783

SEQ ID NO: 173226 - RNA, 1410 nt, Artificial Sequence
  derived and/or modified sequence opt4 from neuraminidase__InfluenzaA__AEG65794
augaaccccaaccagaagaucaucaccaucggcagcgugagccugaccaucagcaccaucugcuucuucaugcagaucgccauccugaucaccaccaucacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173227 - RNA, 1410 nt, Artificial Sequence; identical to SEQ ID NO: 172038
  derived and/or modified sequence opt4 from neuraminidase__InfluenzaA__AEG65805

SEQ ID NO: 173228 - RNA, 1410 nt, Artificial Sequence
  derived and/or modified sequence opt4 from neuraminidase__InfluenzaA__AEG65816
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173229 - RNA, 1410 nt, Artificial Sequence
  derived and/or modified sequence opt4 from neuraminidase__InfluenzaA__AEG79808
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173230 - RNA, 1410 nt, Artificial Sequence; identical to SEQ ID NO: 173229
  derived and/or modified sequence opt4 from neuraminidase__InfluenzaA__AEG79814

SEQ ID NO: 173231 - RNA, 1410 nt, Artificial Sequence
  derived and/or modified sequence opt4 from neuraminidase__InfluenzaA__AEG79826
augaaccccaaccagaagaucaucaccaucagcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccaugggcuggagcuggcccgacggcgccgagcugcccuucaccaucgacaaguga

SEQ ID NO: 173232 - RNA, 1410 nt, Artificial Sequence
  derived and/or modified sequence opt4 from neuraminidase__InfluenzaA__AEG79830
augaaccccaaccagaagaucaucaccaucagcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173233 - RNA, 1410 nt, Artificial Sequence; identical to SEQ ID NO: 172777
  derived and/or modified sequence opt4 from neuraminidase__InfluenzaA__AEG79836

SEQ ID NO: 173234 - RNA, 1410 nt, Artificial Sequence
  derived and/or modified sequence opt4 from neuraminidase__InfluenzaA__AEH59356
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcacccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 173235 - RNA, 1410 nt, Artificial Sequence; identical to SEQ ID NO: 173229
  derived and/or modified sequence opt4 from neuraminidase__InfluenzaA__AEH59360

SEQ ID NO: 173236 - RNA, 1410 nt, Artificial Sequence
  derived and/or modified sequence opt4 from neuraminidase__InfluenzaA__AEH59364
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccaacgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcgccaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173237 - RNA, 1410 nt, Artificial Sequence
  derived and/or modified sequence opt4 from neuraminidase__InfluenzaA__AEH59366
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcggcgugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173238 - RNA, 1410 nt, Artificial Sequence; identical to SEQ ID NO: 173229
  derived and/or modified sequence opt4 from neuraminidase__InfluenzaA__AEH59368

SEQ ID NO: 173239 - RNA, 1410 nt, Artificial Sequence; identical to SEQ ID NO: 172777
  derived and/or modified sequence opt4 from neuraminidase__InfluenzaA__AEH59370

SEQ ID NO: 173240 - RNA, 1410 nt, Artificial Sequence; identical to SEQ ID NO: 173236
  derived and/or modified sequence opt4 from neuraminidase__InfluenzaA__AEH59372

SEQ ID NO: 173241 - RNA, 1410 nt, Artificial Sequence; identical to SEQ ID NO: 173236
  derived and/or modified sequence opt4 from neuraminidase__InfluenzaA__AEH59376

SEQ ID NO: 173242 - RNA, 1410 nt, Artificial Sequence; identical to SEQ ID NO: 172777
  derived and/or modified sequence opt4 from neuraminidase__InfluenzaA__AEH59378

SEQ ID NO: 173243 - RNA, 1410 nt, Artificial Sequence; identical to SEQ ID NO: 173236
  derived and/or modified sequence opt4 from neuraminidase__InfluenzaA__AEH59382

SEQ ID NO: 173244 - RNA, 1410 nt, Artificial Sequence
  derived and/or modified sequence opt4 from neuraminidase__InfluenzaA__AEH59384
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcagaaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173245 - RNA, 1410 nt, Artificial Sequence
  derived and/or modified sequence opt4 from neuraminidase__InfluenzaA__AEH59386
augaaccccaaccagaagaucaucaccaucggcagcgugugcaugaccaucggcauggccaaccugauccugcagaucggcaacaucaucagcaucuggaucagccacagcauccagaucggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173246 - RNA, 1410 nt, Artificial Sequence; identical to SEQ ID NO: 173236
  derived and/or modified sequence opt4 from neuraminidase__InfluenzaA__AEH59388

SEQ ID NO: 173247 - RNA, 1410 nt, Artificial Sequence
  derived and/or modified sequence opt4 from neuraminidase__InfluenzaA__AEH59390
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggccugaacgaguggagcggcuacagcggcagcuucgugcagcaccccgagcugaccggccuggacugcaucagacccugcuucuggguggagcugaucagaggccugcccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173248 - RNA, 1410 nt, Artificial Sequence; identical to SEQ ID NO: 173236
  derived and/or modified sequence opt4 from neuraminidase__InfluenzaA__AEH59392

SEQ ID NO: 173249 - RNA, 1410 nt, Artificial Sequence; identical to SEQ ID NO: 173236
  derived and/or modified sequence opt4 from neuraminidase__InfluenzaA__AEH59396

SEQ ID NO: 173250 - RNA, 1410 nt, Artificial Sequence
  derived and/or modified sequence opt4 from neuraminidase__InfluenzaA__AEH59398
augaaccccaaccagaagaucaucaccaucggcagcgugugcaugaccaucggcguggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacuacauccugagaacccaggagagcgagugcgccugcgugaacggcagcugcuucaccaucaugaccgacggccccagcgacggccaggccagcuacaagaucuucagaaucgagaagggcaagguggugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173251 - RNA, 1410 nt, Artificial Sequence
  derived and/or modified sequence opt4 from neuraminidase__InfluenzaA__AEH59400
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccaacgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcgccaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173252 - RNA, 1410 nt, Artificial Sequence
  derived and/or modified sequence opt4 from neuraminidase__InfluenzaA__AEH59402
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccaacgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcgccaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173253 - RNA, 1410 nt, Artificial Sequence
  derived and/or modified sequence opt4 from neuraminidase__InfluenzaA__AEH59404
augaaccccaaccagaagaucaucaccaucggcagcgccugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagcccguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173254 - RNA, 1410 nt, Artificial Sequence
  derived and/or modified sequence opt4 from neuraminidase__InfluenzaA__AEH59406
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaccuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcuucaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucgacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173255 - RNA, 1410 nt, Artificial Sequence; identical to SEQ ID NO: 172777
  derived and/or modified sequence opt4 from neuraminidase__InfluenzaA__AEH59408

SEQ ID NO: 173256 - RNA, 1410 nt, Artificial Sequence
  derived and/or modified sequence opt4 from neuraminidase__InfluenzaA__AEH59412
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucagaagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugcugagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173257 - RNA, 1410 nt, Artificial Sequence; identical to SEQ ID NO: 173229
  derived and/or modified sequence opt4 from neuraminidase__InfluenzaA__AEH59416

SEQ ID NO: 173258 - RNA, 1410 nt, Artificial Sequence; identical to SEQ ID NO: 169258
  derived and/or modified sequence opt4 from neuraminidase__InfluenzaA__AEH59584

SEQ ID NO: 173259 - RNA, 1410 nt, Artificial Sequence; identical to SEQ ID NO: 169258
  derived and/or modified sequence opt4 from neuraminidase__InfluenzaA__AEH59586

SEQ ID NO: 173260 - RNA, 1410 nt, Artificial Sequence; identical to SEQ ID NO: 169258
  derived and/or modified sequence opt4 from neuraminidase__InfluenzaA__AEH59588

SEQ ID NO: 173261 - RNA, 1410 nt, Artificial Sequence; identical to SEQ ID NO: 169258
  derived and/or modified sequence opt4 from neuraminidase__InfluenzaA__AEH59592

SEQ ID NO: 173262 - RNA, 1410 nt, Artificial Sequence; identical to SEQ ID NO: 169258
  derived and/or modified sequence opt4 from neuraminidase__InfluenzaA__AEH59594

SEQ ID NO: 173263 - RNA, 1410 nt, Artificial Sequence; identical to SEQ ID NO: 169258
  derived and/or modified sequence opt4 from neuraminidase__InfluenzaA__AEH59596

SEQ ID NO: 173264 - RNA, 1410 nt, Artificial Sequence; identical to SEQ ID NO: 169258
  derived and/or modified sequence opt4 from neuraminidase__InfluenzaA__AEH59598

SEQ ID NO: 173265 - RNA, 1410 nt, Artificial Sequence; identical to SEQ ID NO: 169258
  derived and/or modified sequence opt4 from neuraminidase__InfluenzaA__AEH59600

SEQ ID NO: 173266 - RNA, 1410 nt, Artificial Sequence
  derived and/or modified sequence opt4 from neuraminidase__InfluenzaA__AEH59602
augaaccccaaccagaagaucaucaccaucggcagcgugugcaugaccaucggcauggccaaccugauccugcagaucggcaacaucaucagcaucuggaucagccacagcauccagcugggcagccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173267 - RNA, 1410 nt, Artificial Sequence; identical to SEQ ID NO: 169258
  derived and/or modified sequence opt4 from neuraminidase__InfluenzaA__AEH59606

SEQ ID NO: 173268 - RNA, 1410 nt, Artificial Sequence; identical to SEQ ID NO: 169258
  derived and/or modified sequence opt4 from neuraminidase__InfluenzaA__AEH59616

SEQ ID NO: 173269 - RNA, 1410 nt, Artificial Sequence; identical to SEQ ID NO: 169258
  derived and/or modified sequence opt4 from neuraminidase__InfluenzaA__AEH59626

SEQ ID NO: 173270 - RNA, 1413 nt, Artificial Sequence; identical to SEQ ID NO: 169981
  derived and/or modified sequence opt4 from neuraminidase__InfluenzaA__AEH77262

SEQ ID NO: 173271 - RNA, 1410 nt, Artificial Sequence
  derived and/or modified sequence opt4 from neuraminidase__InfluenzaA__AEH77273
augaaccccaaccagaagaucaucaccaucggcagcgugugcaugaccaucggcauggccaaccugauccugcagaucggcaacaucaccagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173272 - RNA, 1410 nt, Artificial Sequence
  derived and/or modified sequence opt4 from neuraminidase__InfluenzaA__AEH77282
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucguggaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 173273 - RNA, 1410 nt, Artificial Sequence; identical to SEQ ID NO: 169258
  derived and/or modified sequence opt4 from neuraminidase__InfluenzaA__AEI29218

SEQ ID NO: 173274 - RNA, 1410 nt, Artificial Sequence; identical to SEQ ID NO: 170625
  derived and/or modified sequence opt4 from neuraminidase__InfluenzaA__AEI29228

SEQ ID NO: 173275 - RNA, 1410 nt, Artificial Sequence; identical to SEQ ID NO: 166657
  derived and/or modified sequence opt4 from neuraminidase__InfluenzaA__AEI54350

SEQ ID NO: 173276 - RNA, 1410 nt, Artificial Sequence; identical to SEQ ID NO: 166670
  derived and/or modified sequence opt4 from neuraminidase__InfluenzaA__AEI54361

SEQ ID NO: 173277 - RNA, 1410 nt, Artificial Sequence; identical to SEQ ID NO: 167234
  derived and/or modified sequence opt4 from neuraminidase__InfluenzaA__AEI54372

SEQ ID NO: 173278 - RNA, 1410 nt, Artificial Sequence; identical to SEQ ID NO: 167111
  derived and/or modified sequence opt4 from neuraminidase__InfluenzaA__AEI54383

SEQ ID NO: 173279 - RNA, 1410 nt, Artificial Sequence; identical to SEQ ID NO: 167234
  derived and/or modified sequence opt4 from neuraminidase__InfluenzaA__AEI54394

SEQ ID NO: 173280 - RNA, 1410 nt, Artificial Sequence; identical to SEQ ID NO: 168404
  derived and/or modified sequence opt4 from neuraminidase__InfluenzaA__AEI54416

SEQ ID NO: 173281 - RNA, 1410 nt, Artificial Sequence; identical to SEQ ID NO: 173224
  derived and/or modified sequence opt4 from neuraminidase__InfluenzaA__AEI54427

SEQ ID NO: 173282 - RNA, 1410 nt, Artificial Sequence; identical to SEQ ID NO: 172038
  derived and/or modified sequence opt4 from neuraminidase__InfluenzaA__AEI54438

SEQ ID NO: 173283 - RNA, 1410 nt, Artificial Sequence; identical to SEQ ID NO: 172038
  derived and/or modified sequence opt4 from neuraminidase__InfluenzaA__AEI54449

SEQ ID NO: 173284 - RNA, 1410 nt, Artificial Sequence; identical to SEQ ID NO: 172038
  derived and/or modified sequence opt4 from neuraminidase__InfluenzaA__AEI54460

SEQ ID NO: 173285 - RNA, 1410 nt, Artificial Sequence
  derived and/or modified sequence opt4 from neuraminidase__InfluenzaA__AEI54471
augaaccccaaccagaagaucaucaccaucggcagcgugagccugaccaucagcaccaucugcuucuucaugcagaucgccgugcugaucaccaccgugacccugcacuucaagcaguacaaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173286 - RNA, 1410 nt, Artificial Sequence; identical to SEQ ID NO: 171930
  derived and/or modified sequence opt4 from neuraminidase__InfluenzaA__AEI54482

SEQ ID NO: 173287 - RNA, 1410 nt, Artificial Sequence
  derived and/or modified sequence opt4 from neuraminidase__InfluenzaA__AEI54493
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugagcaucuga

SEQ ID NO: 173288 - RNA, 1410 nt, Artificial Sequence; identical to SEQ ID NO: 172038
  derived and/or modified sequence opt4 from neuraminidase__InfluenzaA__AEI54504

SEQ ID NO: 173289 - RNA, 1410 nt, Artificial Sequence; identical to SEQ ID NO: 171558
  derived and/or modified sequence opt4 from neuraminidase__InfluenzaA__AEI59982

SEQ ID NO: 173290 - RNA, 1413 nt, Artificial Sequence; identical to SEQ ID NO: 172456
  derived and/or modified sequence opt4 from neuraminidase__InfluenzaA__AEI59993

SEQ ID NO: 173291 - RNA, 1413 nt, Artificial Sequence; identical to SEQ ID NO: 172452
  derived and/or modified sequence opt4 from neuraminidase__InfluenzaA__AEI60004

SEQ ID NO: 173292 - RNA, 1410 nt, Artificial Sequence
  derived and/or modified sequence opt4 from neuraminidase__InfluenzaA__AEI60015
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggcaacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173293 - RNA, 1410 nt, Artificial Sequence; identical to SEQ ID NO: 171004
  derived and/or modified sequence opt4 from neuraminidase__InfluenzaA__AEI60026

SEQ ID NO: 173294 - RNA, 1410 nt, Artificial Sequence
  derived and/or modified sequence opt4 from neuraminidase__InfluenzaA__AEI60037
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaagaaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173295 - RNA, 1410 nt, Artificial Sequence
  derived and/or modified sequence opt4 from neuraminidase__InfluenzaA__AEI60048
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgcccccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173296 - RNA, 1410 nt, Artificial Sequence
  derived and/or modified sequence opt4 from neuraminidase__InfluenzaA__AEI60089
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173297 - RNA, 1410 nt, Artificial Sequence; identical to SEQ ID NO: 173229
  derived and/or modified sequence opt4 from neuraminidase__InfluenzaA__AEI60099

SEQ ID NO: 173298 - RNA, 1410 nt, Artificial Sequence
  derived and/or modified sequence opt4 from neuraminidase__InfluenzaA__AEI60111
augaaccccaaccagaagaucaucaccaucggcagcaucagccugaccaucgccaccaucugcuuccugaugcagaucgccauccuggugaccaccgugacccugcacuucaagcaguacaagugcaacagcccccccaacaacagagugaugcugugcgagcccaccaucaucgagagaaacaucaccgagaucguguaccugaccaacaccaccaucgagaaggagaucugccccaagcuggccgaguacagaaacuggagcaagccccagugcaacaucaagggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcaucaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugagagacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcaggugaacagacaggugaucguggagagaggcaacagaagcggcuacagcggcaucuucagcguggagggcaagagcugcaucaacagaugcuucuacguggagcugaucagaggcagaaaggaggagaccaaggugugguggaccagcaacagcaucgugguguucugcggcaccagcggcaccuacggcaccggcagcuggcccgacggcgccgacaucaacaucaugcccaucuga

SEQ ID NO: 173299 - RNA, 1410 nt, Artificial Sequence; identical to SEQ ID NO: 169258
  derived and/or modified sequence opt4 from neuraminidase__InfluenzaA__AEI73669

SEQ ID NO: 173300 - RNA, 1410 nt, Artificial Sequence
  derived and/or modified sequence opt4 from neuraminidase__InfluenzaA__AEI86727
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcaaguucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173301 - RNA, 1410 nt, Artificial Sequence
  derived and/or modified sequence opt4 from neuraminidase__InfluenzaA__AEI86737
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaagaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagguggugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173302 - RNA, 1410 nt, Artificial Sequence
  derived and/or modified sequence opt4 from neuraminidase__InfluenzaA__AEI86757
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaucagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173303 - RNA, 1410 nt, Artificial Sequence
  derived and/or modified sequence opt4 from neuraminidase__InfluenzaA__AEI86767
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccacaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173304 - RNA, 1410 nt, Artificial Sequence; identical to SEQ ID NO: 173303
  derived and/or modified sequence opt4 from neuraminidase__InfluenzaA__AEI86777

SEQ ID NO: 173305 - RNA, 1410 nt, Artificial Sequence
  derived and/or modified sequence opt4 from neuraminidase__InfluenzaA__AEI86787
augaaccccaaccagaagaucaucaccaucggcagcgugugcaugaccaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173306 - RNA, 1410 nt, Artificial Sequence
  derived and/or modified sequence opt4 from neuraminidase__InfluenzaA__AEI86797
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173307 - RNA, 1410 nt, Artificial Sequence
  derived and/or modified sequence opt4 from neuraminidase__InfluenzaA__AEI86807
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcaagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaucaucgacaaguga

SEQ ID NO: 173308 - RNA, 1410 nt, Artificial Sequence; identical to SEQ ID NO: 173303
  derived and/or modified sequence opt4 from neuraminidase__InfluenzaA__AEI86817

SEQ ID NO: 173309 - RNA, 1410 nt, Artificial Sequence
  derived and/or modified sequence opt4 from neuraminidase__InfluenzaA__AEI86827
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccacaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaccagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccugaacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173310 - RNA, 1410 nt, Artificial Sequence; identical to SEQ ID NO: 173306
  derived and/or modified sequence opt4 from neuraminidase__InfluenzaA__AEI86837

SEQ ID NO: 173311 - RNA, 1410 nt, Artificial Sequence; identical to SEQ ID NO: 172777
  derived and/or modified sequence opt4 from neuraminidase__InfluenzaA__AEI86847

SEQ ID NO: 173312 - RNA, 1410 nt, Artificial Sequence
  derived and/or modified sequence opt4 from neuraminidase__InfluenzaA__AEI86867
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaaccuggccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcaaguucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173313 - RNA, 1410 nt, Artificial Sequence; identical to SEQ ID NO: 173306
  derived and/or modified sequence opt4 from neuraminidase__InfluenzaA__AEI86887

SEQ ID NO: 173314 - RNA, 1410 nt, Artificial Sequence; identical to SEQ ID NO: 173306
  derived and/or modified sequence opt4 from neuraminidase__InfluenzaA__AEI86897

SEQ ID NO: 173315 - RNA, 1410 nt, Artificial Sequence
  derived and/or modified sequence opt4 from neuraminidase__InfluenzaA__AEI86907
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacauccacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173316 - RNA, 1410 nt, Artificial Sequence
  derived and/or modified sequence opt4 from neuraminidase__InfluenzaA__AEI86917
augaaccccaaccagaagaucaucaccaucggcagcaucugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173317 - RNA, 1410 nt, Artificial Sequence; identical to SEQ ID NO: 173229
  derived and/or modified sequence opt4 from neuraminidase__InfluenzaA__AEI86927

SEQ ID NO: 173318 - RNA, 1410 nt, Artificial Sequence; identical to SEQ ID NO: 173303
  derived and/or modified sequence opt4 from neuraminidase__InfluenzaA__AEI86937

SEQ ID NO: 173319 - RNA, 1410 nt, Artificial Sequence
  derived and/or modified sequence opt4 from neuraminidase__InfluenzaA__AEI86947
augaaccccaaccagaagaucaucaccaucggcagcgugugcaugaccaucggcauggccaaccugauccugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173320 - RNA, 1410 nt, Artificial Sequence
  derived and/or modified sequence opt4 from neuraminidase__InfluenzaA__AEI86967
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacgccuucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173321 - RNA, 1410 nt, Artificial Sequence
  derived and/or modified sequence opt4 from neuraminidase__InfluenzaA__AEI86977
augaaccccaaccagaagaucaucaccaucggcagcgugugcaugaccaucggcauggccaaccugauccugcagaucggcaacaucaucagcaucuggaucagccacagcauccagcugggcaaccagaaccagaucggcaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcaccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173322 - RNA, 1410 nt, Artificial Sequence
  derived and/or modified sequence opt4 from neuraminidase__InfluenzaA__AEI86997
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 173323 - RNA, 1410 nt, Artificial Sequence
  derived and/or modified sequence opt4 from neuraminidase__InfluenzaA__AEI87007
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcagccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173324 - RNA, 1410 nt, Artificial Sequence
  derived and/or modified sequence opt4 from neuraminidase__InfluenzaA__AEI87017
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacggcgacaccggcggcuggagcuggcccgacggcgccgagcugcccuucaccaucgacaaguga

SEQ ID NO: 173325 - RNA, 1410 nt, Artificial Sequence; identical to SEQ ID NO: 173229
  derived and/or modified sequence opt4 from neuraminidase__InfluenzaA__AEI87027

SEQ ID NO: 173326 - RNA, 1410 nt, Artificial Sequence; identical to SEQ ID NO: 173322
  derived and/or modified sequence opt4 from neuraminidase__InfluenzaA__AEI87037

SEQ ID NO: 173327 - RNA, 1410 nt, Artificial Sequence; identical to SEQ ID NO: 173306
  derived and/or modified sequence opt4 from neuraminidase__InfluenzaA__AEI87047

SEQ ID NO: 173328 - RNA, 1410 nt, Artificial Sequence
  derived and/or modified sequence opt4 from neuraminidase__InfluenzaA__AEI87057
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173329 - RNA, 1410 nt, Artificial Sequence; identical to SEQ ID NO: 172777
  derived and/or modified sequence opt4 from neuraminidase__InfluenzaA__AEI87067

SEQ ID NO: 173330 - RNA, 1410 nt, Artificial Sequence
  derived and/or modified sequence opt4 from neuraminidase__InfluenzaA__AEI87077
augaaccccaaccagaagaucaucaccaucggcagcaucugcaugaccaucggcauggccaaccugauccugcagaucggcaacaucaucagcaucuggaucagccacagcauccaguucggcaaccagaaccagaucggcaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173331 - RNA, 1410 nt, Artificial Sequence
  derived and/or modified sequence opt4 from neuraminidase__InfluenzaA__AEI87087
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccaucagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcagcgugaacagcgacaccgugggcuggagcuggcccgacggcgccgagcugcccuucaccaucgacaaguga

SEQ ID NO: 173332 - RNA, 1410 nt, Artificial Sequence; identical to SEQ ID NO: 173303
  derived and/or modified sequence opt4 from neuraminidase__InfluenzaA__AEI87097

SEQ ID NO: 173333 - RNA, 1410 nt, Artificial Sequence; identical to SEQ ID NO: 173303
  derived and/or modified sequence opt4 from neuraminidase__InfluenzaA__AEI87107

SEQ ID NO: 173334 - RNA, 1413 nt, Artificial Sequence
  derived and/or modified sequence opt4 from neuraminidase__InfluenzaA__AEI91968
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucaagcccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173335 - RNA, 1410 nt, Artificial Sequence; identical to SEQ ID NO: 169258
  derived and/or modified sequence opt4 from neuraminidase__InfluenzaA__AEI91983

SEQ ID NO: 173336 - RNA, 1410 nt, Artificial Sequence; identical to SEQ ID NO: 171744
  derived and/or modified sequence opt4 from neuraminidase__InfluenzaA__AEI91984

SEQ ID NO: 173337 - RNA, 1410 nt, Artificial Sequence
  derived and/or modified sequence opt4 from neuraminidase__InfluenzaA__AEI92004
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccuacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173338 - RNA, 1413 nt, Artificial Sequence
  derived and/or modified sequence opt4 from neuraminidase__InfluenzaA__AEI92023
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagaagaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcaccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173339 - RNA, 1410 nt, Artificial Sequence
  derived and/or modified sequence opt4 from neuraminidase__InfluenzaA__AEJ10403
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcgccaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173340 - RNA, 1410 nt, Artificial Sequence; identical to SEQ ID NO: 173306
  derived and/or modified sequence opt4 from neuraminidase__InfluenzaA__AEJ10413

SEQ ID NO: 173341 - RNA, 1410 nt, Artificial Sequence; identical to SEQ ID NO: 173328
  derived and/or modified sequence opt4 from neuraminidase__InfluenzaA__AEJ10423

SEQ ID NO: 173342 - RNA, 1410 nt, Artificial Sequence
  derived and/or modified sequence opt4 from neuraminidase__InfluenzaA__AEJ10433
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 173343 - RNA, 1410 nt, Artificial Sequence; identical to SEQ ID NO: 172777
  derived and/or modified sequence opt4 from neuraminidase__InfluenzaA__AEJ10443

SEQ ID NO: 173344 - RNA, 1410 nt, Artificial Sequence; identical to SEQ ID NO: 172777
  derived and/or modified sequence opt4 from neuraminidase__InfluenzaA__AEJ10453

SEQ ID NO: 173345 - RNA, 1410 nt, Artificial Sequence; identical to SEQ ID NO: 173229
  derived and/or modified sequence opt4 from neuraminidase__InfluenzaA__AEJ10463

SEQ ID NO: 173346 - RNA, 1410 nt, Artificial Sequence
  derived and/or modified sequence opt4 from neuraminidase__InfluenzaA__AEJ10473
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaagaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccugaacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173347 - RNA, 1410 nt, Artificial Sequence; identical to SEQ ID NO: 172777
  derived and/or modified sequence opt4 from neuraminidase__InfluenzaA__AEJ10503

SEQ ID NO: 173348 - RNA, 1410 nt, Artificial Sequence; identical to SEQ ID NO: 169258
  derived and/or modified sequence opt4 from neuraminidase__InfluenzaA__AEJ10523

SEQ ID NO: 173349 - RNA, 1410 nt, Artificial Sequence; identical to SEQ ID NO: 169258
  derived and/or modified sequence opt4 from neuraminidase__InfluenzaA__AEJ10533

SEQ ID NO: 173350 - RNA, 1410 nt, Artificial Sequence; identical to SEQ ID NO: 169258
  derived and/or modified sequence opt4 from neuraminidase__InfluenzaA__AEJ10543

SEQ ID NO: 173351 - RNA, 1410 nt, Artificial Sequence; identical to SEQ ID NO: 169258
  derived and/or modified sequence opt4 from neuraminidase__InfluenzaA__AEJ10553

SEQ ID NO: 173352 - RNA, 1410 nt, Artificial Sequence; identical to SEQ ID NO: 171533
  derived and/or modified sequence opt4 from neuraminidase__InfluenzaA__AEJ10563

SEQ ID NO: 173353 - RNA, 1410 nt, Artificial Sequence; identical to SEQ ID NO: 171533
  derived and/or modified sequence opt4 from neuraminidase__InfluenzaA__AEJ10573

SEQ ID NO: 173354 - RNA, 1410 nt, Artificial Sequence; identical to SEQ ID NO: 171533
  derived and/or modified sequence opt4 from neuraminidase__InfluenzaA__AEJ10583

SEQ ID NO: 173355 - RNA, 1410 nt, Artificial Sequence
  derived and/or modified sequence opt4 from neuraminidase__InfluenzaA__AEJ36305
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaccagcagcagaaacggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173356 - RNA, 1410 nt, Artificial Sequence; identical to SEQ ID NO: 169258
  derived and/or modified sequence opt4 from neuraminidase__InfluenzaA__AEJ37856

SEQ ID NO: 173357 - RNA, 1410 nt, Artificial Sequence; identical to SEQ ID NO: 169258
  derived and/or modified sequence opt4 from neuraminidase__InfluenzaA__AEJ37866

SEQ ID NO: 173358 - RNA, 1410 nt, Artificial Sequence; identical to SEQ ID NO: 169258
  derived and/or modified sequence opt4 from neuraminidase__InfluenzaA__AEJ37876

SEQ ID NO: 173359 - RNA, 1410 nt, Artificial Sequence; identical to SEQ ID NO: 173306
  derived and/or modified sequence opt4 from neuraminidase__InfluenzaA__AEJ37886

SEQ ID NO: 173360 - RNA, 1410 nt, Artificial Sequence
  derived and/or modified sequence opt4 from neuraminidase__InfluenzaA__AEJ37896
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcagaaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173361 - RNA, 1410 nt, Artificial Sequence; identical to SEQ ID NO: 173306
  derived and/or modified sequence opt4 from neuraminidase__InfluenzaA__AEJ37906

SEQ ID NO: 173362 - RNA, 1410 nt, Artificial Sequence; identical to SEQ ID NO: 173306
  derived and/or modified sequence opt4 from neuraminidase__InfluenzaA__AEJ37916

SEQ ID NO: 173363 - RNA, 1410 nt, Artificial Sequence; identical to SEQ ID NO: 173306
  derived and/or modified sequence opt4 from neuraminidase__InfluenzaA__AEJ37926

SEQ ID NO: 173364 - RNA, 1410 nt, Artificial Sequence; identical to SEQ ID NO: 171160
  derived and/or modified sequence opt4 from neuraminidase__InfluenzaA__AEJ37936

SEQ ID NO: 173365 - RNA, 1410 nt, Artificial Sequence; identical to SEQ ID NO: 169258
  derived and/or modified sequence opt4 from neuraminidase__InfluenzaA__AEJ37946

SEQ ID NO: 173366 - RNA, 1410 nt, Artificial Sequence; identical to SEQ ID NO: 173306
  derived and/or modified sequence opt4 from neuraminidase__InfluenzaA__AEJ37956

SEQ ID NO: 173367 - RNA, 1410 nt, Artificial Sequence; identical to SEQ ID NO: 173306
  derived and/or modified sequence opt4 from neuraminidase__InfluenzaA__AEJ37966

SEQ ID NO: 173368 - RNA, 1410 nt, Artificial Sequence; identical to SEQ ID NO: 169258
  derived and/or modified sequence opt4 from neuraminidase__InfluenzaA__AEJ37976

SEQ ID NO: 173369 - RNA, 1410 nt, Artificial Sequence; identical to SEQ ID NO: 173306
  derived and/or modified sequence opt4 from neuraminidase__InfluenzaA__AEJ37986

SEQ ID NO: 173370 - RNA, 1410 nt, Artificial Sequence; identical to SEQ ID NO: 171930
  derived and/or modified sequence opt4 from neuraminidase__InfluenzaA__AEK21372

SEQ ID NO: 173371 - RNA, 1413 nt, Artificial Sequence; identical to SEQ ID NO: 172724
  derived and/or modified sequence opt4 from neuraminidase__InfluenzaA__AEK21383

SEQ ID NO: 173372 - RNA, 1410 nt, Artificial Sequence; identical to SEQ ID NO: 171160
  derived and/or modified sequence opt4 from neuraminidase__InfluenzaA__AEK21399

SEQ ID NO: 173373 - RNA, 1410 nt, Artificial Sequence; identical to SEQ ID NO: 169258
  derived and/or modified sequence opt4 from neuraminidase__InfluenzaA__AEK21409

SEQ ID NO: 173374 - RNA, 1410 nt, Artificial Sequence; identical to SEQ ID NO: 173229
  derived and/or modified sequence opt4 from neuraminidase__InfluenzaA__AEK21419

SEQ ID NO: 173375 - RNA, 1410 nt, Artificial Sequence; identical to SEQ ID NO: 173306
  derived and/or modified sequence opt4 from neuraminidase__InfluenzaA__AEK21429

SEQ ID NO: 173376 - RNA, 1410 nt, Artificial Sequence
  derived and/or modified sequence opt4 from neuraminidase__InfluenzaA__AEK21439
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaagaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173377 - RNA, 1410 nt, Artificial Sequence; identical to SEQ ID NO: 173306
  derived and/or modified sequence opt4 from neuraminidase__InfluenzaA__AEK21449

SEQ ID NO: 173378 - RNA, 1410 nt, Artificial Sequence; identical to SEQ ID NO: 171160
  derived and/or modified sequence opt4 from neuraminidase__InfluenzaA__AEK21459

SEQ ID NO: 173379 - RNA, 1410 nt, Artificial Sequence; identical to SEQ ID NO: 173306
  derived and/or modified sequence opt4 from neuraminidase__InfluenzaA__AEK21469

SEQ ID NO: 173380 - RNA, 1410 nt, Artificial Sequence; identical to SEQ ID NO: 173306
  derived and/or modified sequence opt4 from neuraminidase__InfluenzaA__AEK21479

SEQ ID NO: 173381 - RNA, 1410 nt, Artificial Sequence; identical to SEQ ID NO: 169258
  derived and/or modified sequence opt4 from neuraminidase__InfluenzaA__AEK21489

SEQ ID NO: 173382 - RNA, 1410 nt, Artificial Sequence; identical to SEQ ID NO: 172974
  derived and/or modified sequence opt4 from neuraminidase__InfluenzaA__AEK28776

SEQ ID NO: 173383 - RNA, 1410 nt, Artificial Sequence
  derived and/or modified sequence opt4 from neuraminidase__InfluenzaA__AEK28787
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcagaagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173384 - RNA, 1410 nt, Artificial Sequence
  derived and/or modified sequence opt4 from neuraminidase__InfluenzaA__AEK28798
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcaacgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugcagcgaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173385 - RNA, 1410 nt, Artificial Sequence
  derived and/or modified sequence opt4 from neuraminidase__InfluenzaA__AEK28809
augaaccccaaccagaagaucaucaccaucggcagcgugagccugaccaucagcaccaucugcuucuucaugcagaucgccauccugaucaccaccgugaccgugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaaggugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173386 - RNA, 1410 nt, Artificial Sequence
  derived and/or modified sequence opt4 from neuraminidase__InfluenzaA__AEK28819
augaaccccaaccagaagaucaucaccaucggcagcgugagccugaccaucagcaccaucugcuucuucaugcagaucgccauccugaucaccaccgugacccugcacuucaagcaguacgaguucaacuacccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagagagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173387 - RNA, 1410 nt, Artificial Sequence
  derived and/or modified sequence opt4 from neuraminidase__InfluenzaA__AEK28830
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaaccuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173388 - RNA, 1410 nt, Artificial Sequence
  derived and/or modified sequence opt4 from neuraminidase__InfluenzaA__AEK28841
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccaccgugaacaacgugcacagcaacaacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173389 - RNA, 1410 nt, Artificial Sequence
  derived and/or modified sequence opt4 from neuraminidase__InfluenzaA__AEK28852
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagaagaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacagagugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173390 - RNA, 1410 nt, Artificial Sequence; identical to SEQ ID NO: 171004
  derived and/or modified sequence opt4 from neuraminidase__InfluenzaA__AEK28863

SEQ ID NO: 173391 - RNA, 1410 nt, Artificial Sequence
  derived and/or modified sequence opt4 from neuraminidase__InfluenzaA__AEK28874
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaaggugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173392 - RNA, 1410 nt, Artificial Sequence
  derived and/or modified sequence opt4 from neuraminidase__InfluenzaA__AEK28885
augaaccccaaccagaagaucaucaccaucggcagcgugagccugaccaucagcaccaucugcuucuucaugcagaucgccauccugaucaccaccgugacccugcacuucaagcaguacgaguucaaccugccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173393 - RNA, 1410 nt, Artificial Sequence; identical to SEQ ID NO: 171129
  derived and/or modified sequence opt4 from neuraminidase__InfluenzaA__AEK28896

SEQ ID NO: 173394 - RNA, 1410 nt, Artificial Sequence
  derived and/or modified sequence opt4 from neuraminidase__InfluenzaA__AEK28907
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagaagaacaucaccgagaucguguaccugaccaacaccaccaucgagaaggagaucugccccagacuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173395 - RNA, 1410 nt, Artificial Sequence; identical to SEQ ID NO: 169119
  derived and/or modified sequence opt4 from neuraminidase__InfluenzaA__AEK28918

SEQ ID NO: 173396 - RNA, 1410 nt, Artificial Sequence; identical to SEQ ID NO: 170425
  derived and/or modified sequence opt4 from neuraminidase__InfluenzaA__AEK28929

SEQ ID NO: 173397 - RNA, 1410 nt, Artificial Sequence
  derived and/or modified sequence opt4 from neuraminidase__InfluenzaA__AEK28951
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggcccuguggaccagcaacagcaucgugguguucugcggcaccagcggcaccuacggcaccggcagcuggcccgacggcgccgaccugaaccugaugcccaucuga

SEQ ID NO: 173398 - RNA, 1410 nt, Artificial Sequence
  derived and/or modified sequence opt4 from neuraminidase__InfluenzaA__AEK28962
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccccaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173399 - RNA, 1410 nt, Artificial Sequence
  derived and/or modified sequence opt4 from neuraminidase__InfluenzaA__AEK28973
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaacuucaugcccaucuga

SEQ ID NO: 173400 - RNA, 1410 nt, Artificial Sequence
  derived and/or modified sequence opt4 from neuraminidase__InfluenzaA__AEK28984
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcgugagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173401 - RNA, 1410 nt, Artificial Sequence; identical to SEQ ID NO: 173400
  derived and/or modified sequence opt4 from neuraminidase__InfluenzaA__AEK28995

SEQ ID NO: 173402 - RNA, 1410 nt, Artificial Sequence; identical to SEQ ID NO: 172038
  derived and/or modified sequence opt4 from neuraminidase__InfluenzaA__AEK29006

SEQ ID NO: 173403 - RNA, 1410 nt, Artificial Sequence
  derived and/or modified sequence opt4 from neuraminidase__InfluenzaA__AEK29028
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173404 - RNA, 1410 nt, Artificial Sequence
  derived and/or modified sequence opt4 from neuraminidase__InfluenzaA__AEK29050
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173405 - RNA, 1410 nt, Artificial Sequence
  derived and/or modified sequence opt4 from neuraminidase__InfluenzaA__AEK29061
augaaccccaaccagaagaucaucaccaucggcagcgugagccugaccaucagcaccaucugcuucuucauccagaucgccauccugaucaccaccgugacccugcacuucaagcaguacgaguucaacagcccccccaacaaccaggugaugcugugcgagcccaccaucaucgagaagaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaucgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173406 - RNA, 1410 nt, Artificial Sequence
  derived and/or modified sequence opt4 from neuraminidase__InfluenzaA__AEK29083
augaaccccaaccagaagaucaucaccaucggcagcgugagccugaccaucagcaccaucugcuucuucauccagaucgccauccugaucaccaccgugacccugcacuucaagcaguacgaguucaacagcccccccaacaaccaggugaugcugugcgagcccaccaucaucgagaagaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173407 - RNA, 1410 nt, Artificial Sequence; identical to SEQ ID NO: 171930
  derived and/or modified sequence opt4 from neuraminidase__InfluenzaA__AEK29094

SEQ ID NO: 173408 - RNA, 1410 nt, Artificial Sequence; identical to SEQ ID NO: 172038
  derived and/or modified sequence opt4 from neuraminidase__InfluenzaA__AEK29127

SEQ ID NO: 173409 - RNA, 1410 nt, Artificial Sequence; identical to SEQ ID NO: 172038
  derived and/or modified sequence opt4 from neuraminidase__InfluenzaA__AEK29138

SEQ ID NO: 173410 - RNA, 1410 nt, Artificial Sequence
  derived and/or modified sequence opt4 from neuraminidase__InfluenzaA__AEK29182
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcaggugaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173411 - RNA, 1410 nt, Artificial Sequence
  derived and/or modified sequence opt4 from neuraminidase__InfluenzaA__AEK29204
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccaacaccaaggugcuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173412 - RNA, 1410 nt, Artificial Sequence
  derived and/or modified sequence opt4 from neuraminidase__InfluenzaA__AEK29215
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173413 - RNA, 1410 nt, Artificial Sequence; identical to SEQ ID NO: 173411
  derived and/or modified sequence opt4 from neuraminidase__InfluenzaA__AEK29237

SEQ ID NO: 173414 - RNA, 1410 nt, Artificial Sequence; identical to SEQ ID NO: 172038
  derived and/or modified sequence opt4 from neuraminidase__InfluenzaA__AEK29248

SEQ ID NO: 173415 - RNA, 1410 nt, Artificial Sequence; identical to SEQ ID NO: 172038
  derived and/or modified sequence opt4 from neuraminidase__InfluenzaA__AEK29259

SEQ ID NO: 173416 - RNA, 1410 nt, Artificial Sequence; identical to SEQ ID NO: 172038
  derived and/or modified sequence opt4 from neuraminidase__InfluenzaA__AEK29270

SEQ ID NO: 173417 - RNA, 1413 nt, Artificial Sequence
  derived and/or modified sequence opt4 from neuraminidase__InfluenzaA__AEK59839
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggccugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173418 - RNA, 1410 nt, Artificial Sequence
  derived and/or modified sequence opt4 from neuraminidase__InfluenzaA__AEK98375
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173419 - RNA, 1410 nt, Artificial Sequence; identical to SEQ ID NO: 169119
  derived and/or modified sequence opt4 from neuraminidase__InfluenzaA__AEK98377

SEQ ID NO: 173420 - RNA, 1410 nt, Artificial Sequence; identical to SEQ ID NO: 168561
  derived and/or modified sequence opt4 from neuraminidase__InfluenzaA__AEK98379

SEQ ID NO: 173421 - RNA, 1410 nt, Artificial Sequence
  derived and/or modified sequence opt4 from neuraminidase__InfluenzaA__AEK98381
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcgaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173422 - RNA, 1410 nt, Artificial Sequence; identical to SEQ ID NO: 168561
  derived and/or modified sequence opt4 from neuraminidase__InfluenzaA__AEK98383

SEQ ID NO: 173423 - RNA, 1410 nt, Artificial Sequence; identical to SEQ ID NO: 169119
  derived and/or modified sequence opt4 from neuraminidase__InfluenzaA__AEK98385

SEQ ID NO: 173424 - RNA, 1410 nt, Artificial Sequence
  derived and/or modified sequence opt4 from neuraminidase__InfluenzaA__AEK98387
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugaucgacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173425 - RNA, 1410 nt, Artificial Sequence; identical to SEQ ID NO: 169119
  derived and/or modified sequence opt4 from neuraminidase__InfluenzaA__AEK98389

SEQ ID NO: 173426 - RNA, 1410 nt, Artificial Sequence
  derived and/or modified sequence opt4 from neuraminidase__InfluenzaA__AEK98393
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgccagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173427 - RNA, 1410 nt, Artificial Sequence; identical to SEQ ID NO: 172038
  derived and/or modified sequence opt4 from neuraminidase__InfluenzaA__AEK98395

SEQ ID NO: 173428 - RNA, 1410 nt, Artificial Sequence
  derived and/or modified sequence opt4 from neuraminidase__InfluenzaA__AEK98397
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaacuucaugcccaucuga

SEQ ID NO: 173429 - RNA, 1410 nt, Artificial Sequence; identical to SEQ ID NO: 169119
  derived and/or modified sequence opt4 from neuraminidase__InfluenzaA__AEK98399

SEQ ID NO: 173430 - RNA, 1410 nt, Artificial Sequence; identical to SEQ ID NO: 169032
  derived and/or modified sequence opt4 from neuraminidase__InfluenzaA__AEK98403

SEQ ID NO: 173431 - RNA, 1410 nt, Artificial Sequence
  derived and/or modified sequence opt4 from neuraminidase__InfluenzaA__AEK98405
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagagacaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173432 - RNA, 1410 nt, Artificial Sequence
  derived and/or modified sequence opt4 from neuraminidase__InfluenzaA__AEK98407
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagugagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagagacaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173433 - RNA, 1410 nt, Artificial Sequence; identical to SEQ ID NO: 166847
  derived and/or modified sequence opt4 from neuraminidase__InfluenzaA__AEL11690

SEQ ID NO: 173434 - RNA, 1410 nt, Artificial Sequence; identical to SEQ ID NO: 171533
  derived and/or modified sequence opt4 from neuraminidase__InfluenzaA__AEL89300

SEQ ID NO: 173435 - RNA, 1410 nt, Artificial Sequence; identical to SEQ ID NO: 171533
  derived and/or modified sequence opt4 from neuraminidase__InfluenzaA__AEL89310

SEQ ID NO: 173436 - RNA, 1410 nt, Artificial Sequence; identical to SEQ ID NO: 171533
  derived and/or modified sequence opt4 from neuraminidase__InfluenzaA__AEL89320

SEQ ID NO: 173437 - RNA, 1410 nt, Artificial Sequence; identical to SEQ ID NO: 171533
  derived and/or modified sequence opt4 from neuraminidase__InfluenzaA__AEL89330

SEQ ID NO: 173438 - RNA, 1410 nt, Artificial Sequence; identical to SEQ ID NO: 171533
  derived and/or modified sequence opt4 from neuraminidase__InfluenzaA__AEL89340

SEQ ID NO: 173439 - RNA, 1410 nt, Artificial Sequence; identical to SEQ ID NO: 171533
  derived and/or modified sequence opt4 from neuraminidase__InfluenzaA__AEL89350

SEQ ID NO: 173440 - RNA, 1410 nt, Artificial Sequence; identical to SEQ ID NO: 171533
  derived and/or modified sequence opt4 from neuraminidase__InfluenzaA__AEL89360

SEQ ID NO: 173441 - RNA, 1410 nt, Artificial Sequence; identical to SEQ ID NO: 171533
  derived and/or modified sequence opt4 from neuraminidase__InfluenzaA__AEL89370

SEQ ID NO: 173442 - RNA, 1410 nt, Artificial Sequence; identical to SEQ ID NO: 171533
  derived and/or modified sequence opt4 from neuraminidase__InfluenzaA__AEL89394

SEQ ID NO: 173443 - RNA, 1410 nt, Artificial Sequence; identical to SEQ ID NO: 171533
  derived and/or modified sequence opt4 from neuraminidase__InfluenzaA__AEL89404

SEQ ID NO: 173444 - RNA, 1410 nt, Artificial Sequence; identical to SEQ ID NO: 171533
  derived and/or modified sequence opt4 from neuraminidase__InfluenzaA__AEL89414

SEQ ID NO: 173445 - RNA, 1410 nt, Artificial Sequence; identical to SEQ ID NO: 171533
  derived and/or modified sequence opt4 from neuraminidase__InfluenzaA__AEL89424

SEQ ID NO: 173446 - RNA, 1410 nt, Artificial Sequence; identical to SEQ ID NO: 171533
  derived and/or modified sequence opt4 from neuraminidase__InfluenzaA__AEL89434

SEQ ID NO: 173447 - RNA, 1410 nt, Artificial Sequence; identical to SEQ ID NO: 171533
  derived and/or modified sequence opt4 from neuraminidase__InfluenzaA__AEL89444

SEQ ID NO: 173448 - RNA, 1410 nt, Artificial Sequence; identical to SEQ ID NO: 171533
  derived and/or modified sequence opt4 from neuraminidase__InfluenzaA__AEL89454

SEQ ID NO: 173449 - RNA, 1410 nt, Artificial Sequence; identical to SEQ ID NO: 171533
  derived and/or modified sequence opt4 from neuraminidase__InfluenzaA__AEL89464

SEQ ID NO: 173450 - RNA, 1410 nt, Artificial Sequence; identical to SEQ ID NO: 171533
  derived and/or modified sequence opt4 from neuraminidase__InfluenzaA__AEL89474

SEQ ID NO: 173451 - RNA, 1410 nt, Artificial Sequence
  derived and/or modified sequence opt4 from neuraminidase__InfluenzaA__AEL89484
augaaccccaaccagaagaucaucaccaucggcagcgugugcaugaccaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaucaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173452 - RNA, 1410 nt, Artificial Sequence; identical to SEQ ID NO: 173322
  derived and/or modified sequence opt4 from neuraminidase__InfluenzaA__AEL89494

SEQ ID NO: 173453 - RNA, 1410 nt, Artificial Sequence; identical to SEQ ID NO: 173328
  derived and/or modified sequence opt4 from neuraminidase__InfluenzaA__AEL89514

SEQ ID NO: 173454 - RNA, 1410 nt, Artificial Sequence; identical to SEQ ID NO: 173306
  derived and/or modified sequence opt4 from neuraminidase__InfluenzaA__AEL89524

SEQ ID NO: 173455 - RNA, 1410 nt, Artificial Sequence
  derived and/or modified sequence opt4 from neuraminidase__InfluenzaA__AEL89534
augaaccccaaccagaagaucaucaccaucggcagcgugugcaugaccaucggcauggccaaccugauccugcagaucggcaacaucaucagcaucuggaucagccacagcauccagcugggcaaccagaaccagaucggcaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaucaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaagaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173456 - RNA, 1410 nt, Artificial Sequence; identical to SEQ ID NO: 173328
  derived and/or modified sequence opt4 from neuraminidase__InfluenzaA__AEL89544

SEQ ID NO: 173457 - RNA, 1410 nt, Artificial Sequence; identical to SEQ ID NO: 173328
  derived and/or modified sequence opt4 from neuraminidase__InfluenzaA__AEL89554

SEQ ID NO: 173458 - RNA, 1410 nt, Artificial Sequence
  derived and/or modified sequence opt4 from neuraminidase__InfluenzaA__AEL89564
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcguggugaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173459 - RNA, 1410 nt, Artificial Sequence; identical to SEQ ID NO: 173328
  derived and/or modified sequence opt4 from neuraminidase__InfluenzaA__AEL89574

SEQ ID NO: 173460 - RNA, 1410 nt, Artificial Sequence; identical to SEQ ID NO: 173328
  derived and/or modified sequence opt4 from neuraminidase__InfluenzaA__AEL89584

SEQ ID NO: 173461 - RNA, 1410 nt, Artificial Sequence; identical to SEQ ID NO: 170275
  derived and/or modified sequence opt4 from neuraminidase__InfluenzaA__AEL89604

SEQ ID NO: 173462 - RNA, 1410 nt, Artificial Sequence; identical to SEQ ID NO: 172777
  derived and/or modified sequence opt4 from neuraminidase__InfluenzaA__AEL89624

SEQ ID NO: 173463 - RNA, 1410 nt, Artificial Sequence
  derived and/or modified sequence opt4 from neuraminidase__InfluenzaA__AEL89634
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuacaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173464 - RNA, 1410 nt, Artificial Sequence; identical to SEQ ID NO: 171533
  derived and/or modified sequence opt4 from neuraminidase__InfluenzaA__AEL89644

SEQ ID NO: 173465 - RNA, 1410 nt, Artificial Sequence; identical to SEQ ID NO: 173229
  derived and/or modified sequence opt4 from neuraminidase__InfluenzaA__AEL89654

SEQ ID NO: 173466 - RNA, 1410 nt, Artificial Sequence; identical to SEQ ID NO: 172777
  derived and/or modified sequence opt4 from neuraminidase__InfluenzaA__AEL89664

SEQ ID NO: 173467 - RNA, 1410 nt, Artificial Sequence; identical to SEQ ID NO: 172777
  derived and/or modified sequence opt4 from neuraminidase__InfluenzaA__AEL89674

SEQ ID NO: 173468 - RNA, 1410 nt, Artificial Sequence; identical to SEQ ID NO: 172777
  derived and/or modified sequence opt4 from neuraminidase__InfluenzaA__AEL89694

SEQ ID NO: 173469 - RNA, 1410 nt, Artificial Sequence
  derived and/or modified sequence opt4 from neuraminidase__InfluenzaA__AEL89704
augaaccccaaccagaagaucaucaccaucggcagcgugugcaugaccaucggcauggccaaccugauccugcagaucggcaacaucauccugaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccaacgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcgugaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173470 - RNA, 1410 nt, Artificial Sequence; identical to SEQ ID NO: 173469
  derived and/or modified sequence opt4 from neuraminidase__InfluenzaA__AEL89714

SEQ ID NO: 173471 - RNA, 1410 nt, Artificial Sequence; identical to SEQ ID NO: 172777
  derived and/or modified sequence opt4 from neuraminidase__InfluenzaA__AEL89744

SEQ ID NO: 173472 - RNA, 1410 nt, Artificial Sequence
  derived and/or modified sequence opt4 from neuraminidase__InfluenzaA__AEL89754
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaucaucgacaaguga

SEQ ID NO: 173473 - RNA, 1410 nt, Artificial Sequence; identical to SEQ ID NO: 171533
  derived and/or modified sequence opt4 from neuraminidase__InfluenzaA__AEL89774

SEQ ID NO: 173474 - RNA, 1410 nt, Artificial Sequence
  derived and/or modified sequence opt4 from neuraminidase__InfluenzaA__AEL89784
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagccugagaaacggcuucgagaugaucugggaccccaacggcuggaccggcaccgacaacaacuucagcgugaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173475 - RNA, 1410 nt, Artificial Sequence
  derived and/or modified sequence opt4 from neuraminidase__InfluenzaA__AEL89794
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacgccgugggcuggagcuggcccgacggcgccgagcugcccuucaccaucgacaaguga

SEQ ID NO: 173476 - RNA, 1410 nt, Artificial Sequence; identical to SEQ ID NO: 173229
  derived and/or modified sequence opt4 from neuraminidase__InfluenzaA__AEL89804

SEQ ID NO: 173477 - RNA, 1410 nt, Artificial Sequence
  derived and/or modified sequence opt4 from neuraminidase__InfluenzaA__AEL89815
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcgugaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173478 - RNA, 1410 nt, Artificial Sequence
  derived and/or modified sequence opt4 from neuraminidase__InfluenzaA__AEL89825
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcgccaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173479 - RNA, 1410 nt, Artificial Sequence
  derived and/or modified sequence opt4 from neuraminidase__InfluenzaA__AEL89835
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173480 - RNA, 1410 nt, Artificial Sequence
  derived and/or modified sequence opt4 from neuraminidase__InfluenzaA__AEL89845
augaaccccaaccagaagaucaucaccaucggcagcgugugcaugaccaucggcauggccaaccugauccugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccaccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggcccccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173481 - RNA, 1410 nt, Artificial Sequence; identical to SEQ ID NO: 173478
  derived and/or modified sequence opt4 from neuraminidase__InfluenzaA__AEL89855

SEQ ID NO: 173482 - RNA, 1410 nt, Artificial Sequence; identical to SEQ ID NO: 172777
  derived and/or modified sequence opt4 from neuraminidase__InfluenzaA__AEL93581

SEQ ID NO: 173483 - RNA, 1410 nt, Artificial Sequence
  derived and/or modified sequence opt4 from neuraminidase__InfluenzaA__AEL93591
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaaccuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173484 - RNA, 1410 nt, Artificial Sequence; identical to SEQ ID NO: 173229
  derived and/or modified sequence opt4 from neuraminidase__InfluenzaA__AEL93601

SEQ ID NO: 173485 - RNA, 1410 nt, Artificial Sequence; identical to SEQ ID NO: 172777
  derived and/or modified sequence opt4 from neuraminidase__InfluenzaA__AEL93611

SEQ ID NO: 173486 - RNA, 1410 nt, Artificial Sequence; identical to SEQ ID NO: 172777
  derived and/or modified sequence opt4 from neuraminidase__InfluenzaA__AEL93621

SEQ ID NO: 173487 - RNA, 1410 nt, Artificial Sequence; identical to SEQ ID NO: 172777
  derived and/or modified sequence opt4 from neuraminidase__InfluenzaA__AEL93631

SEQ ID NO: 173488 - RNA, 1410 nt, Artificial Sequence
  derived and/or modified sequence opt4 from neuraminidase__InfluenzaA__AEL93641
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccacaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggccagcccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173489 - RNA, 1410 nt, Artificial Sequence; identical to SEQ ID NO: 173328
  derived and/or modified sequence opt4 from neuraminidase__InfluenzaA__AEL94890

SEQ ID NO: 173490 - RNA, 1410 nt, Artificial Sequence
  derived and/or modified sequence opt4 from neuraminidase__InfluenzaA__AEL95429
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173491 - RNA, 1410 nt, Artificial Sequence
  derived and/or modified sequence opt4 from neuraminidase__InfluenzaA__AEL97634
augaaccccaaccagaagaucaucaccaucggcagcgugugcaugaccaucggcauggccaaccugauccugcagaucggcaacaucaucagcaucugggugagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcgugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173492 - RNA, 1410 nt, Artificial Sequence; identical to SEQ ID NO: 169258
  derived and/or modified sequence opt4 from neuraminidase__InfluenzaA__AEL99667

SEQ ID NO: 173493 - RNA, 1410 nt, Artificial Sequence; identical to SEQ ID NO: 169258
  derived and/or modified sequence opt4 from neuraminidase__InfluenzaA__AEL99677

SEQ ID NO: 173494 - RNA, 1410 nt, Artificial Sequence; identical to SEQ ID NO: 168296
  derived and/or modified sequence opt4 from neuraminidase__InfluenzaA__AEM53471

SEQ ID NO: 173495 - RNA, 1413 nt, Artificial Sequence; identical to SEQ ID NO: 168973
  derived and/or modified sequence opt4 from neuraminidase__InfluenzaA__AEM60040

SEQ ID NO: 173496 - RNA, 1413 nt, Artificial Sequence; identical to SEQ ID NO: 168563
  derived and/or modified sequence opt4 from neuraminidase__InfluenzaA__AEM60061

SEQ ID NO: 173497 - RNA, 1410 nt, Artificial Sequence
  derived and/or modified sequence opt4 from neuraminidase__InfluenzaA__AEM60072
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 173498 - RNA, 1410 nt, Artificial Sequence; identical to SEQ ID NO: 169258
  derived and/or modified sequence opt4 from neuraminidase__InfluenzaA__AEM62774

SEQ ID NO: 173499 - RNA, 1410 nt, Artificial Sequence; identical to SEQ ID NO: 169258
  derived and/or modified sequence opt4 from neuraminidase__InfluenzaA__AEM62783

SEQ ID NO: 173500 - RNA, 1410 nt, Artificial Sequence
  derived and/or modified sequence opt4 from neuraminidase__InfluenzaA__AEM62792
augaaccccaaccagaagaucaucaccaucggcagcgugugcaugaccaucggcauggccaaccugauccugcagaucggcaacaucaucagcaucuggaucagccacagcauccagcugggcagccagaaccagaucgagaccugcaaccagagcgugaucaccuacgagaacaacaccugggugaaccagaccuacgugaacaucagcaacaccaacuucgccgccggccagagcgugaucagcgugagacuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173501 - RNA, 1410 nt, Artificial Sequence; identical to SEQ ID NO: 169258
  derived and/or modified sequence opt4 from neuraminidase__InfluenzaA__AEM62801

SEQ ID NO: 173502 - RNA, 1410 nt, Artificial Sequence
  derived and/or modified sequence opt4 from neuraminidase__InfluenzaA__AEM62810
augaaccccaaccagaagaucaucaccaucggcagcgugugcaugaccaucggcaugggcaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173503 - RNA, 1410 nt, Artificial Sequence
  derived and/or modified sequence opt4 from neuraminidase__InfluenzaA__AEM62819
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacgacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173504 - RNA, 1410 nt, Artificial Sequence; identical to SEQ ID NO: 169258
  derived and/or modified sequence opt4 from neuraminidase__InfluenzaA__AEM62828

SEQ ID NO: 173505 - RNA, 1410 nt, Artificial Sequence; identical to SEQ ID NO: 169841
  derived and/or modified sequence opt4 from neuraminidase__InfluenzaA__AEM62837

SEQ ID NO: 173506 - RNA, 1410 nt, Artificial Sequence; identical to SEQ ID NO: 169258
  derived and/or modified sequence opt4 from neuraminidase__InfluenzaA__AEM62846

SEQ ID NO: 173507 - RNA, 1410 nt, Artificial Sequence
  derived and/or modified sequence opt4 from neuraminidase__InfluenzaA__AEM62855
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcggcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173508 - RNA, 1410 nt, Artificial Sequence
  derived and/or modified sequence opt4 from neuraminidase__InfluenzaA__AEM62864
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucuucggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173509 - RNA, 1410 nt, Artificial Sequence
  derived and/or modified sequence opt4 from neuraminidase__InfluenzaA__AEM62872
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcuucaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173510 - RNA, 1410 nt, Artificial Sequence; identical to SEQ ID NO: 169258
  derived and/or modified sequence opt4 from neuraminidase__InfluenzaA__AEM92310

SEQ ID NO: 173511 - RNA, 1410 nt, Artificial Sequence; identical to SEQ ID NO: 170720
  derived and/or modified sequence opt4 from neuraminidase__InfluenzaA__AEM92320

SEQ ID NO: 173512 - RNA, 1410 nt, Artificial Sequence
  derived and/or modified sequence opt4 from neuraminidase__InfluenzaA__AEM92340
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccagaaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173513 - RNA, 1410 nt, Artificial Sequence; identical to SEQ ID NO: 170720
  derived and/or modified sequence opt4 from neuraminidase__InfluenzaA__AEM92350

SEQ ID NO: 173514 - RNA, 1410 nt, Artificial Sequence
  derived and/or modified sequence opt4 from neuraminidase__InfluenzaA__AEM92360
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccgagcagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173515 - RNA, 1410 nt, Artificial Sequence; identical to SEQ ID NO: 173512
  derived and/or modified sequence opt4 from neuraminidase__InfluenzaA__AEM92370

SEQ ID NO: 173516 - RNA, 1410 nt, Artificial Sequence; identical to SEQ ID NO: 173512
  derived and/or modified sequence opt4 from neuraminidase__InfluenzaA__AEM92380

SEQ ID NO: 173517 - RNA, 1410 nt, Artificial Sequence
  derived and/or modified sequence opt4 from neuraminidase__InfluenzaA__AEM92399
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaccaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugcugagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173518 - RNA, 1410 nt, Artificial Sequence; identical to SEQ ID NO: 173517
  derived and/or modified sequence opt4 from neuraminidase__InfluenzaA__AEM92409

SEQ ID NO: 173519 - RNA, 1410 nt, Artificial Sequence; identical to SEQ ID NO: 169682
  derived and/or modified sequence opt4 from neuraminidase__InfluenzaA__AEM92419

SEQ ID NO: 173520 - RNA, 1410 nt, Artificial Sequence
  derived and/or modified sequence opt4 from neuraminidase__InfluenzaA__AEM92430
augaaccccaaccagaagaucaugaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173521 - RNA, 1410 nt, Artificial Sequence
  derived and/or modified sequence opt4 from neuraminidase__InfluenzaA__AEM92440
augaaccccaaccagaagaucaucaccaucggcagcgugugcaucaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaucgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173522 - RNA, 1410 nt, Artificial Sequence; identical to SEQ ID NO: 173478
  derived and/or modified sequence opt4 from neuraminidase__InfluenzaA__AEM92450

SEQ ID NO: 173523 - RNA, 1410 nt, Artificial Sequence; identical to SEQ ID NO: 173478
  derived and/or modified sequence opt4 from neuraminidase__InfluenzaA__AEM92460

SEQ ID NO: 173524 - RNA, 1410 nt, Artificial Sequence; identical to SEQ ID NO: 173229
  derived and/or modified sequence opt4 from neuraminidase__InfluenzaA__AEM92470

SEQ ID NO: 173525 - RNA, 1410 nt, Artificial Sequence; identical to SEQ ID NO: 173229
  derived and/or modified sequence opt4 from neuraminidase__InfluenzaA__AEM92480

SEQ ID NO: 173526 - RNA, 1410 nt, Artificial Sequence
  derived and/or modified sequence opt4 from neuraminidase__InfluenzaA__AEM92490
augaaccccaaccagaagaucaucaccaucggcagcgugugcaugaucaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173527 - RNA, 1410 nt, Artificial Sequence
  derived and/or modified sequence opt4 from neuraminidase__InfluenzaA__AEM92500
augaaccccaaccagaagaucaucaccaucggcagcgugugcaugaucaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173528 - RNA, 1410 nt, Artificial Sequence
  derived and/or modified sequence opt4 from neuraminidase__InfluenzaA__AEM92520
augaaccccaaccagaagaucaucaccaucggcagcgugugcaugaccaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173529 - RNA, 1410 nt, Artificial Sequence; identical to SEQ ID NO: 173229
  derived and/or modified sequence opt4 from neuraminidase__InfluenzaA__AEM92550

SEQ ID NO: 173530 - RNA, 1410 nt, Artificial Sequence
  derived and/or modified sequence opt4 from neuraminidase__InfluenzaA__AEM92570
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcaacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173531 - RNA, 1410 nt, Artificial Sequence
  derived and/or modified sequence opt4 from neuraminidase__InfluenzaA__AEM92580
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173532 - RNA, 1410 nt, Artificial Sequence; identical to SEQ ID NO: 173229
  derived and/or modified sequence opt4 from neuraminidase__InfluenzaA__AEM92590

SEQ ID NO: 173533 - RNA, 1410 nt, Artificial Sequence; identical to SEQ ID NO: 173229
  derived and/or modified sequence opt4 from neuraminidase__InfluenzaA__AEM92600

SEQ ID NO: 173534 - RNA, 1410 nt, Artificial Sequence
  derived and/or modified sequence opt4 from neuraminidase__InfluenzaA__AEM92610
augaaccccaaccagaagaucaucaccaucggcagcgugugcaugaccaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugagcuggagcuggcccgacggcgccgagcugcccuucaccaucgacaaguga

SEQ ID NO: 173535 - RNA, 1410 nt, Artificial Sequence
  derived and/or modified sequence opt4 from neuraminidase__InfluenzaA__AEM92620
augaaccccaaccagaagaucaucaccaucggcagcgugugcaugaucaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcuggacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173536 - RNA, 1410 nt, Artificial Sequence
  derived and/or modified sequence opt4 from neuraminidase__InfluenzaA__AEM92650
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaccaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173537 - RNA, 1410 nt, Artificial Sequence; identical to SEQ ID NO: 171930
  derived and/or modified sequence opt4 from neuraminidase__InfluenzaA__AEM98410

SEQ ID NO: 173538 - RNA, 1410 nt, Artificial Sequence; identical to SEQ ID NO: 171930
  derived and/or modified sequence opt4 from neuraminidase__InfluenzaA__AEM98421

SEQ ID NO: 173539 - RNA, 1410 nt, Artificial Sequence; identical to SEQ ID NO: 171930
  derived and/or modified sequence opt4 from neuraminidase__InfluenzaA__AEM98432

SEQ ID NO: 173540 - RNA, 1410 nt, Artificial Sequence; identical to SEQ ID NO: 173306
  derived and/or modified sequence opt4 from neuraminidase__InfluenzaA__AEN55401

SEQ ID NO: 173541 - RNA, 1410 nt, Artificial Sequence; identical to SEQ ID NO: 171533
  derived and/or modified sequence opt4 from neuraminidase__InfluenzaA__AEN55411

SEQ ID NO: 173542 - RNA, 1410 nt, Artificial Sequence
  derived and/or modified sequence opt4 from neuraminidase__InfluenzaA__AEN55421
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccagacagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173543 - RNA, 1410 nt, Artificial Sequence
  derived and/or modified sequence opt4 from neuraminidase__InfluenzaA__AEN55466
augaaccccaaccagaagaucaucaccaucggcagcgugugcaucaccaucggcauggccaaccugauccugcagaucggcaacaccaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173544 - RNA, 1410 nt, Artificial Sequence
  derived and/or modified sequence opt4 from neuraminidase__InfluenzaA__AEN55476
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugagcuggagcuggcccgacggcgccgagcugcccuucaccaucgacaaguga

SEQ ID NO: 173545 - RNA, 1410 nt, Artificial Sequence; identical to SEQ ID NO: 172777
  derived and/or modified sequence opt4 from neuraminidase__InfluenzaA__AEN55486

SEQ ID NO: 173546 - RNA, 1410 nt, Artificial Sequence; identical to SEQ ID NO: 172777
  derived and/or modified sequence opt4 from neuraminidase__InfluenzaA__AEN55506

SEQ ID NO: 173547 - RNA, 1410 nt, Artificial Sequence
  derived and/or modified sequence opt4 from neuraminidase__InfluenzaA__AEN55516
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcagaggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173548 - RNA, 1410 nt, Artificial Sequence; identical to SEQ ID NO: 172777
  derived and/or modified sequence opt4 from neuraminidase__InfluenzaA__AEN55526

SEQ ID NO: 173549 - RNA, 1410 nt, Artificial Sequence; identical to SEQ ID NO: 173306
  derived and/or modified sequence opt4 from neuraminidase__InfluenzaA__AEN69429

SEQ ID NO: 173550 - RNA, 1410 nt, Artificial Sequence; identical to SEQ ID NO: 173303
  derived and/or modified sequence opt4 from neuraminidase__InfluenzaA__AEN69438

SEQ ID NO: 173551 - RNA, 1410 nt, Artificial Sequence; identical to SEQ ID NO: 171533
  derived and/or modified sequence opt4 from neuraminidase__InfluenzaA__AEN69484

SEQ ID NO: 173552 - RNA, 1410 nt, Artificial Sequence; identical to SEQ ID NO: 169205
  derived and/or modified sequence opt4 from neuraminidase__InfluenzaA__AEO01627

SEQ ID NO: 173553 - RNA, 1410 nt, Artificial Sequence; identical to SEQ ID NO: 169205
  derived and/or modified sequence opt4 from neuraminidase__InfluenzaA__AEO01638

SEQ ID NO: 173554 - RNA, 1410 nt, Artificial Sequence
  derived and/or modified sequence opt4 from neuraminidase__InfluenzaA__AEO01644
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaccgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173555 - RNA, 1410 nt, Artificial Sequence
  derived and/or modified sequence opt4 from neuraminidase__InfluenzaA__AEO01654
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccaaggugcuguggaccagcaacagcaucgugguguucugcggcaccagcggcaccuacggcaccggcagcuggcccgacggcgccgagaucaaccugaugcccaucuga

SEQ ID NO: 173556 - RNA, 1413 nt, Artificial Sequence; identical to SEQ ID NO: 169152
  derived and/or modified sequence opt4 from neuraminidase__InfluenzaA__AEO01665

SEQ ID NO: 173557 - RNA, 1413 nt, Artificial Sequence
  derived and/or modified sequence opt4 from neuraminidase__InfluenzaA__AEO01676
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucuucuucagaggcgacaacagcgacaccgccaacuggagcuggcccgacggcgccgagaugaccuucaccaucgacaaguga

SEQ ID NO: 173558 - RNA, 1410 nt, Artificial Sequence; identical to SEQ ID NO: 169205
  derived and/or modified sequence opt4 from neuraminidase__InfluenzaA__AEO01693

SEQ ID NO: 173559 - RNA, 1413 nt, Artificial Sequence; identical to SEQ ID NO: 169152
  derived and/or modified sequence opt4 from neuraminidase__InfluenzaA__AEO01711

SEQ ID NO: 173560 - RNA, 1410 nt, Artificial Sequence; identical to SEQ ID NO: 173328
  derived and/or modified sequence opt4 from neuraminidase__InfluenzaA__AEO37533

SEQ ID NO: 173561 - RNA, 1410 nt, Artificial Sequence
  derived and/or modified sequence opt4 from neuraminidase__InfluenzaA__AEO37543
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagcccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcgugaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173562 - RNA, 1410 nt, Artificial Sequence; identical to SEQ ID NO: 172777
  derived and/or modified sequence opt4 from neuraminidase__InfluenzaA__AEO72179

SEQ ID NO: 173563 - RNA, 1350 nt, Artificial Sequence
  derived and/or modified sequence opt4 from neuraminidase__InfluenzaA__AEO88957
augaaccccaaccagaagaucaucaccaucggcagcaucugcauggugaucggcaucgugagccugaugcugcagaucggcaacaugaucagcaucugggugagccacagcacccagaccggcaaccagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173564 - RNA, 1350 nt, Artificial Sequence
  derived and/or modified sequence opt4 from neuraminidase__InfluenzaA__AEO88965
augaaccccaaccagaagaucaucaccaucggcagcaucugcauggugaucgagaucgugagccugaugcugcagaucggcaacaugaucagcaucugggugagccacagcauccagaccaagaaccagagacaggccgagcccaucagcaacaccaaguuccugaccgagaaggccguggccagcgugacccuggccggcaacagcagccugugccccaucagcggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccugaacugcaucagacccugcuucuggguggagcuggugagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 173565 - RNA, 1350 nt, Artificial Sequence
  derived and/or modified sequence opt4 from neuraminidase__InfluenzaA__AEO88973
augaaccccaaccagaagaucaucaccaucggcagcaucugcauggugaucggcaucgugagccugaugcugcagaucggcaacaugaucagccugugggugagccacagcauccagaccggcaaccagcaccagguggagcccaucagcaacaccaacuuccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaugaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcagaguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagccccaacagcagaagcggcuucgagaugaucugggaccccaacggcuggaucgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173566 - RNA, 1350 nt, Artificial Sequence
  derived and/or modified sequence opt4 from neuraminidase__InfluenzaA__AEO88982
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagaaacaccaacuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcaucuucggcgacaaccccagaccccacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacgacgccgagcugcccuucaccaucgacaaguga

SEQ ID NO: 173567 - RNA, 1350 nt, Artificial Sequence
  derived and/or modified sequence opt4 from neuraminidase__InfluenzaA__AEO88990
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagaaacaccaacuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacgacgccgagcugcccuucaccaucgacaaguga

SEQ ID NO: 173568 - RNA, 1350 nt, Artificial Sequence
  derived and/or modified sequence opt4 from neuraminidase__InfluenzaA__AEO88998
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacgagcaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173569 - RNA, 1350 nt, Artificial Sequence
  derived and/or modified sequence opt4 from neuraminidase__InfluenzaA__AEO89006
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagaaacaccaacuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcgugaagcaggacaucaucgccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173570 - RNA, 1350 nt, Artificial Sequence
  derived and/or modified sequence opt4 from neuraminidase__InfluenzaA__AEO89023
augaaccccaaccagaagaucaucaccaucggcagcaucugcauggugaucggcaucgugagccugaugcugcagaucggcaacauggugagccugugggugagccacagcauccagaccggcaaccagcaccagguggagcccaucagcaacaccaacuuccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaugaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagccccagcagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173571 - RNA, 1350 nt, Artificial Sequence
  derived and/or modified sequence opt4 from neuraminidase__InfluenzaA__AEO89032
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagaaacaccaacuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173572 - RNA, 1350 nt, Artificial Sequence
  derived and/or modified sequence opt4 from neuraminidase__InfluenzaA__AEO89041
augaaccccaaccagaagaucaucaccaucggcagcaucugcauggugaucggccuggugagccugaugcugcagaucggcaacaugaucagcaucugggugagccacagcauccagaccggcaaccagcaccaggccgagcccaucagaaacaccaacuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggaucgagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173573 - RNA, 1350 nt, Artificial Sequence
  derived and/or modified sequence opt4 from neuraminidase__InfluenzaA__AEO89050
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccaugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173574 - RNA, 1350 nt, Artificial Sequence
  derived and/or modified sequence opt4 from neuraminidase__InfluenzaA__AEO89058
augaaccccaaccagaagaucaucaccaucggcagcaucugcauggugaucggcaucgugagccugaugcugcagaucggcaacaugaucagcaucugggugagccacagcauccagaccggcaaccagagacaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggacuaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173575 - RNA, 1350 nt, Artificial Sequence
  derived and/or modified sequence opt4 from neuraminidase__InfluenzaA__AEO89075
augaaccccaaccagaagaucaucaccaucggcagcaucugcauggugaucggcaucgugagccugaugcugcagaucggcaacaugaucagcaucugggugagccacagcauccagagaggcaaccugaaccagguggagcccaucagcaacaccaacuuccugaccgagaaggccguggccagcgugacccuggccggcaacagcagccugugccccaucagaggcugggccauccacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggugcccagccccuacaacagcagauucgagagcguggccuggagcgccagcgccugccacgacggcaccagcuggcugaccaucggcaucagcggccccgacaacggcgccguggccguggugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagccccaacagcagaagcggcuucgagaugaucugggaccccaacggcuggagcgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173576 - RNA, 1350 nt, Artificial Sequence
  derived and/or modified sequence opt4 from neuraminidase__InfluenzaA__AEO89084
augaaccccaaccagaagaucaucaccaucggcagcaucugcauggugaucggcaucgugagccugaugcugcagaucggcaacaugaucagcaucuggaucagcuacagcauccagaccggcaaccagcaccaggccgagcccaccagaaacgccaccuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagauggagaagggcaagguggugaagagcguggagcugaucgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccgagaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173577 - RNA, 1350 nt, Artificial Sequence
  derived and/or modified sequence opt4 from neuraminidase__InfluenzaA__AEO89093
augaaccccaaccagaagaucaucaccaucggcagcaucugcauggugaucggcaucgugagccugaugcugcagaucggcaacaugaucagccugugggugagccacagcauccagaccggcaaccagcaccagguggagcccaucagcaacaccaacuuccugguggagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaugaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcagaguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagccccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173578 - RNA, 1350 nt, Artificial Sequence
  derived and/or modified sequence opt4 from neuraminidase__InfluenzaA__AEO89102
augaaccccaaccagaagaucaucaccaucggcagcaucugcauggugaucggcaucgugagccugaugcugcagaucggcaacaugaucagcaucuggaucagccacagcauccagaccggcaaccagaaccagguggagcccaucagcaacaccaacuuccugaccgagaaggccguggccagcgugauccuggccggcaacagcagccugugccccaucagaggcugggccauccacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccacaacggcgccuacggcgugaagggcuucagcuucaaguacggcaacggcguguggaucggcagaaccaagagccccaacagcagaagcggcuucgagaugaucugggaccccaacggcuggagcgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccguguggaccagcggcagcagcaucagcuucugcggcgugaacagcgacaccgugagcuggagcuggcccgacggcgccgagcugcccuucaccaucgacaaguga

SEQ ID NO: 173579 - RNA, 1350 nt, Artificial Sequence
  derived and/or modified sequence opt4 from neuraminidase__InfluenzaA__AEO89111
augaaccccaaccagaagaucaucaccaucggcagcaucugcauggugaucggcaucgugagccugaugcugcagaucggcaacaucaucagcaucugggugagccacagcauccagaccggcaaccagcaccaggacgagcccaucagaaacgccaacgugcugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcgaccccgugagccccaacggcgccuacggcaucaagggcuucagcuucaaguacggcaacggcguguggaucggcagaaccaagagcaccaacagcagaagcggcuucgagaugaucugggaccccaacggcuggaccgagaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173580 - RNA, 1350 nt, Artificial Sequence
  derived and/or modified sequence opt4 from neuraminidase__InfluenzaA__AEO89120
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagaaacgccagcuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcugggccgagaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagggcaccaucuggaccagcggcagcagcaucagcuucugcggcgugaacagcgacaccgugagcuggagcuggcccgacggcgccgagcugcccuucaccaucgacaaguga

SEQ ID NO: 173581 - RNA, 1350 nt, Artificial Sequence
  derived and/or modified sequence opt4 from neuraminidase__InfluenzaA__AEO89129
augaaccccaaccagaagaucaucaccaucggcagcaucugcauggugaucggcaucgugagccugaugcugcagaucggcaacaucaucagcaucugggugagccacagcacccagaccggcaaccagcaccaggacgagcccaucagaaacgccaacuuccugaccgagaacgccguggccagcgugacccuggccggcaacagcagccugugccccgugagaggcugggccgugcacagcaaggacaacagcaucagagugggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcgaccccgugagccccaacggcgccuacggcaucaagggcuucagcuucaaguacggcaacggcguguggaucggcagaaccaagagcaccaacagcagaagcggcuucgagaugaucugggaccccaacggcuggaccgagaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173582 - RNA, 1350 nt, Artificial Sequence
  derived and/or modified sequence opt4 from neuraminidase__InfluenzaA__AEO89138
augaaccccaaccagaagaucaucaccaucggcagcaucugcauggugaccggcaucgugagccugaugcugcagaucggcaacaucaucagcaugugggugagccacagcauccagaccagaaaccagcaccaggccgagcccaucagaaacaccaacuuccugaccgagaacgccguggccagcgugacccugaccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacaacgacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccguguggaccagcggcagcagcaucagcuucugcggcgugaacagcgacaccgugagcuggagcuggcccgacggcgccgagcugcccuucaccaucgacaaguga

SEQ ID NO: 173583 - RNA, 1350 nt, Artificial Sequence
  derived and/or modified sequence opt4 from neuraminidase__InfluenzaA__AEO89156
augaaccccaaccagaagaucaucaccaucggcagcaucugcauggugaccggcaucgugagccugaugcugcagaucggcaacaucaccagcaugugggugagccacagcauccagaccagaaaccagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173584 - RNA, 1350 nt, Artificial Sequence
  derived and/or modified sequence opt4 from neuraminidase__InfluenzaA__AEO89174
augaaccccaaccagaagaucaucaccaucggcagcaucugcauggugaccggcaucgugagccugaugcugcagaucggcaacaucaucagcaugugggugagccacagcauccagaccagaaaccagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173585 - RNA, 1350 nt, Artificial Sequence
  derived and/or modified sequence opt4 from neuraminidase__InfluenzaA__AEO89183
augaaccccaaccagaagaucgugaccaucggcagcaucugcauggugaucggcaucgugagccugaugcugcagaucggcaacaugaucagcaucugggugagccacagcauccagaccggcaaccagcaccagaccgagcccaucagaaacaccaacuuccugaccgagaacaccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccaucggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaagggcagcugcggccccgugagccccaacggcgccuacggcgugaagggcuucagcuucaaguacggcaacggcguguggaucggcagaaccaagagcacccacagcagaagcggcuucgagaugaucugggaccccaacggcuggaccggcaccgacagcgaguucagcaugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173586 - RNA, 1350 nt, Artificial Sequence
  derived and/or modified sequence opt4 from neuraminidase__InfluenzaA__AEO89205
augaaccccacccagaagaucaucaccaucggcagcaucugcauggugaucggcaucgugagccugaugcugcagaucggcaacaugaucagcaucugggugagccacagcauccagaccggcaaccagcaccaggccgagcccaucagaaacgccagcuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcugggccgagaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagggcaccaucuggaccagcggcagcagcaucagcuucugcggcgugaacagcgacaccgugagcuggagcuggcccgacggcgccgagcugcccuucaccaucgacaaguga

SEQ ID NO: 173587 - RNA, 1350 nt, Artificial Sequence
  derived and/or modified sequence opt4 from neuraminidase__InfluenzaA__AEO89215
augaaccccaaccagaagaucaucaccaucggcagcaucugcauggccaucggcaucgugagccugaugcugcagaucggcaacaugaucagcaucugggugagccacagcauccagaccggcaaccagcaccaggccgagcccaucagaaacgccagcuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcugggccgagaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagggcaccaucuggaccagcggcagcagcaucagcuucugcggcgugaacagcgacaccgugagcuggagcuggcccgacggcgccgagcugcccuucaccaucgacaaguga

SEQ ID NO: 173588 - RNA, 1350 nt, Artificial Sequence
  derived and/or modified sequence opt4 from neuraminidase__InfluenzaA__AEO89226
augaaccccacccagaagaucaucaccaucggcagcaucugcauggccaucggcaucgugagccugaugcugcagaucggcaacaugaucagcaucugggugagccacagcauccagaccggcaaccagcaccaggccgagcccaucagaaacgccagcuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcugggccgagaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagggcaccaucuggaccagcggcagcagcaucagcuucugcggcgugaacagcgacaccgugagcuggagcuggcccgacggcgccgagcugcccuucaccaucgacaaguga

SEQ ID NO: 173589 - RNA, 1350 nt, Artificial Sequence
  derived and/or modified sequence opt4 from neuraminidase__InfluenzaA__AEO89237
augaaccccaaccagaagaucaucaccaucggcagcaucugcauggugaucggcaucgugagccugaugcugcagaucggcaacaucaucagcaugugggugagccacagcauccagaccagaaaccagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173590 - RNA, 1350 nt, Artificial Sequence
  derived and/or modified sequence opt4 from neuraminidase__InfluenzaA__AEO89248
augaaccccaaccagaagaucaucaccaucggcagcaucugcauggugaucggcaucgugagccugaugcugcagaucggcaacaucaucagcaucugggugagccacagcuuccagaccagagugcagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagaugaagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcaugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173591 - RNA, 1350 nt, Artificial Sequence
  derived and/or modified sequence opt4 from neuraminidase__InfluenzaA__AEO89270
augaaccccaaccagaagaucaucaccaucggcagcaucugcauggugaccggcaucgugagccugaugcugcagaucggcaacaucaccagcaugugggugagccacagcauccagaccagaaaccagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 173592 - RNA, 1350 nt, Artificial Sequence
  derived and/or modified sequence opt4 from neuraminidase__InfluenzaA__AEO89281
augaaccccaaccagaagaucaucaccaucggcagcaucugcaugguggugggcaucgugagccugaugcugcagaucggcaacaucgugagcaucugggugagccacagcauccagaccggccaccagcagcaggccgagcccaucaagaacaccaacuuccugaccaagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacacccugagaacccaggagagcgagugcgccugcgugaacggcagcugcuucaccgugaugaccgacggccccagcaacggccaggccagcuacaagaucuucaagauggagaagggcaagguggugaagagcgccgagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcaugaagcaggacaucguggccaucaccgaguggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173593 - RNA, 1350 nt, Artificial Sequence
  derived and/or modified sequence opt4 from neuraminidase__InfluenzaA__AEO89291
augaaccccaaccagaagaucaucaccaucggcagcaucugcaugguggugggcaucgugagccugaugcugcagaucggcaacaucgugagcaucugggugagccacagcauccagaccggccaccagcagcaggccgagcccaucaagaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcgccgagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcaugaagcaggacaucguggccaucaccgaguggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 173594 - RNA, 1350 nt, Artificial Sequence
  derived and/or modified sequence opt4 from neuraminidase__InfluenzaA__AEO89302
augaaccccaaccagaagaucaucaccaucggcagcaucugcauggugaucggcaucgugagccugaugcugcagaucggcaacaucaucagcaucugggugagccacagcauccagaccggcaaccagcaccaggacgagcccaucagaaacgccaacuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugagaagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcgaccccgugagccccaacggcgccuacggcaucaagggcuucagcuucaaguacggcaacggcguguggaucggcagaaccaagagcaccaacagcagaagcggcuucgagaugaucugggaccccaacggcuggaccgagaccgacagcgacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugagcagcgacaccgugagcuggagcuggcccgacggcgccgagcugcccuucaccaucgacaaguga

SEQ ID NO: 173595 - RNA, 1410 nt, Artificial Sequence; identical to SEQ ID NO: 168577
  derived and/or modified sequence opt4 from neuraminidase__InfluenzaA__AEO99218

SEQ ID NO: 173596 - RNA, 1410 nt, Artificial Sequence
  derived and/or modified sequence opt4 from neuraminidase__InfluenzaA__AEQ49739
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgaggugaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173597 - RNA, 1410 nt, Artificial Sequence; identical to SEQ ID NO: 172777
  derived and/or modified sequence opt4 from neuraminidase__InfluenzaA__AEQ49740

SEQ ID NO: 173598 - RNA, 1410 nt, Artificial Sequence
  derived and/or modified sequence opt4 from neuraminidase__InfluenzaA__AEQ49741
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173599 - RNA, 1410 nt, Artificial Sequence
  derived and/or modified sequence opt4 from neuraminidase__InfluenzaA__AEQ49742
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccauccacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173600 - RNA, 1410 nt, Artificial Sequence
  derived and/or modified sequence opt4 from neuraminidase__InfluenzaA__AEQ49743
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaacuga

SEQ ID NO: 173601 - RNA, 1410 nt, Artificial Sequence
  derived and/or modified sequence opt4 from neuraminidase__InfluenzaA__AEQ49744
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccuggugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacaucuucagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccaggaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcagaacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173602 - RNA, 1410 nt, Artificial Sequence; identical to SEQ ID NO: 173598
  derived and/or modified sequence opt4 from neuraminidase__InfluenzaA__AEQ49745

SEQ ID NO: 173603 - RNA, 1410 nt, Artificial Sequence; identical to SEQ ID NO: 173598
  derived and/or modified sequence opt4 from neuraminidase__InfluenzaA__AEQ49746

SEQ ID NO: 173604 - RNA, 1410 nt, Artificial Sequence; identical to SEQ ID NO: 173598
  derived and/or modified sequence opt4 from neuraminidase__InfluenzaA__AEQ49747

SEQ ID NO: 173605 - RNA, 1410 nt, Artificial Sequence; identical to SEQ ID NO: 172777
  derived and/or modified sequence opt4 from neuraminidase__InfluenzaA__AEQ49748

SEQ ID NO: 173606 - RNA, 1410 nt, Artificial Sequence; identical to SEQ ID NO: 173598
  derived and/or modified sequence opt4 from neuraminidase__InfluenzaA__AEQ49749

SEQ ID NO: 173607 - RNA, 1410 nt, Artificial Sequence
  derived and/or modified sequence opt4 from neuraminidase__InfluenzaA__AEQ49750
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaaccacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagaacaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173608 - RNA, 1410 nt, Artificial Sequence
  derived and/or modified sequence opt4 from neuraminidase__InfluenzaA__AEQ49751
augaaccccaaccagaagaucaucaccaucggcagcgugugcaugaccaucggcauggccaaccugauccugcagaucggcaacaucaucagcaucuggaucagccacagcuuccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaaccacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173609 - RNA, 1410 nt, Artificial Sequence
  derived and/or modified sequence opt4 from neuraminidase__InfluenzaA__AEQ49752
augaaccccaaccagaagaucaucaccaucggcagcgugugcaugaccaucggcauggccaaccugauccugcagaucggcaacaucaucagcaucuggaucagccacagcauccagcugggcaaccagagccagaucggcaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173610 - RNA, 1410 nt, Artificial Sequence
  derived and/or modified sequence opt4 from neuraminidase__InfluenzaA__AEQ49753
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 173611 - RNA, 1410 nt, Artificial Sequence
  derived and/or modified sequence opt4 from neuraminidase__InfluenzaA__AEQ49754
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcaacaccgugggcuggagcuggcccgacggcgccgagcugcccuucaccaucgacaaguga

SEQ ID NO: 173612 - RNA, 1410 nt, Artificial Sequence; identical to SEQ ID NO: 173598
  derived and/or modified sequence opt4 from neuraminidase__InfluenzaA__AEQ49755

SEQ ID NO: 173613 - RNA, 1410 nt, Artificial Sequence
  derived and/or modified sequence opt4 from neuraminidase__InfluenzaA__AEQ49756
augaaccccaaccagaagaucaucaccaucggcagcgugugcaugaccaucggcauggccaaccugauccugcagaucggcaacaucaucagcaucuggaucagccacagcauccagcugggcaaccagagccagguggagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173614 - RNA, 1410 nt, Artificial Sequence; identical to SEQ ID NO: 173598
  derived and/or modified sequence opt4 from neuraminidase__InfluenzaA__AEQ49757

SEQ ID NO: 173615 - RNA, 1410 nt, Artificial Sequence
  derived and/or modified sequence opt4 from neuraminidase__InfluenzaA__AEQ49758
augaaccccaaccagaagaucaucaccaucggcagcgugugcaugaccaucggcauggccaaccugauccugcagaucggcaacaucaucagcaucuggaucagccacagcauccagcugggcaaccacagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcugggccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173616 - RNA, 1410 nt, Artificial Sequence; identical to SEQ ID NO: 173598
  derived and/or modified sequence opt4 from neuraminidase__InfluenzaA__AEQ49759

SEQ ID NO: 173617 - RNA, 1410 nt, Artificial Sequence; identical to SEQ ID NO: 173598
  derived and/or modified sequence opt4 from neuraminidase__InfluenzaA__AEQ49760

SEQ ID NO: 173618 - RNA, 1410 nt, Artificial Sequence
  derived and/or modified sequence opt4 from neuraminidase__InfluenzaA__AEQ49761
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccuggcugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccccagcgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagaagcaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173619 - RNA, 1410 nt, Artificial Sequence
  derived and/or modified sequence opt4 from neuraminidase__InfluenzaA__AEQ49762
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccuggaucaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaucaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173620 - RNA, 1410 nt, Artificial Sequence; identical to SEQ ID NO: 173598
  derived and/or modified sequence opt4 from neuraminidase__InfluenzaA__AEQ49763

SEQ ID NO: 173621 - RNA, 1410 nt, Artificial Sequence; identical to SEQ ID NO: 173598
  derived and/or modified sequence opt4 from neuraminidase__InfluenzaA__AEQ49764

SEQ ID NO: 173622 - RNA, 1410 nt, Artificial Sequence; identical to SEQ ID NO: 173598
  derived and/or modified sequence opt4 from neuraminidase__InfluenzaA__AEQ49765

SEQ ID NO: 173623 - RNA, 1410 nt, Artificial Sequence
  derived and/or modified sequence opt4 from neuraminidase__InfluenzaA__AEQ49766
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcugaccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173624 - RNA, 1410 nt, Artificial Sequence
  derived and/or modified sequence opt4 from neuraminidase__InfluenzaA__AEQ49767
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuacaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggcaugggcugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173625 - RNA, 1410 nt, Artificial Sequence; identical to SEQ ID NO: 172777
  derived and/or modified sequence opt4 from neuraminidase__InfluenzaA__AEQ49768

SEQ ID NO: 173626 - RNA, 1410 nt, Artificial Sequence; identical to SEQ ID NO: 173598
  derived and/or modified sequence opt4 from neuraminidase__InfluenzaA__AEQ49769

SEQ ID NO: 173627 - RNA, 1410 nt, Artificial Sequence
  derived and/or modified sequence opt4 from neuraminidase__InfluenzaA__AEQ49770
augaaccccaaccagaagaucaucaccaucggcagcgugugcaugaccaucggcauggccaaccugauccugcagaucggcaacaucaucagcguguggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccguggacaaguga

SEQ ID NO: 173628 - RNA, 1410 nt, Artificial Sequence; identical to SEQ ID NO: 173611
  derived and/or modified sequence opt4 from neuraminidase__InfluenzaA__AEQ49771

SEQ ID NO: 173629 - RNA, 1410 nt, Artificial Sequence; identical to SEQ ID NO: 172777
  derived and/or modified sequence opt4 from neuraminidase__InfluenzaA__AEQ49772

SEQ ID NO: 173630 - RNA, 1410 nt, Artificial Sequence
  derived and/or modified sequence opt4 from neuraminidase__InfluenzaA__AEQ49773
augaaccccaaccagaagaucaucaccaucggcagcaucugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcaacaccgugggcuggagcuggcccgacggcgccgagcugcccuucaccaucgacaaguga

SEQ ID NO: 173631 - RNA, 1410 nt, Artificial Sequence
  derived and/or modified sequence opt4 from neuraminidase__InfluenzaA__AEQ49774
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgaguacaacaccugggugaaccagaccuacaucaacaucagcaacaccaacuucgccgccggccagagcguggugagcgugaagcuggugggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuacgagaugaucugggaccccaacggcuggaccggcaccgacaacaacuucagcaucaagcaggacaucgugggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173632 - RNA, 1410 nt, Artificial Sequence; identical to SEQ ID NO: 172777
  derived and/or modified sequence opt4 from neuraminidase__InfluenzaA__AEQ49775

SEQ ID NO: 173633 - RNA, 1410 nt, Artificial Sequence
  derived and/or modified sequence opt4 from neuraminidase__InfluenzaA__AEQ49776
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccccagcgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaccgagaacaccaucuggaccagcggcagcagcaucagcuucugcggcgugaacagcgacaccgugggcuggagcuggcccgacggcgccgagcugcccuucaccaucgacaaguga

SEQ ID NO: 173634 - RNA, 1410 nt, Artificial Sequence; identical to SEQ ID NO: 173598
  derived and/or modified sequence opt4 from neuraminidase__InfluenzaA__AEQ49777

SEQ ID NO: 173635 - RNA, 1410 nt, Artificial Sequence
  derived and/or modified sequence opt4 from neuraminidase__InfluenzaA__AEQ49778
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccuggaucaaccagaccuacgugaacaucagcaacaccaacuucgccgccgugcagagcguggugagcgugaagcuggccggcaacagcacccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173636 - RNA, 1410 nt, Artificial Sequence
  derived and/or modified sequence opt4 from neuraminidase__InfluenzaA__AEQ49779
augaaccccaaccagaagaucaucaccaucggcagcgugugcaugaccaucggcauggccaaccugauccugcagaucggcaacaucaucagcaucuggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccguggacaaguga

SEQ ID NO: 173637 - RNA, 1410 nt, Artificial Sequence; identical to SEQ ID NO: 172777
  derived and/or modified sequence opt4 from neuraminidase__InfluenzaA__AEQ49780

SEQ ID NO: 173638 - RNA, 1410 nt, Artificial Sequence; identical to SEQ ID NO: 172777
  derived and/or modified sequence opt4 from neuraminidase__InfluenzaA__AEQ49781

SEQ ID NO: 173639 - RNA, 1410 nt, Artificial Sequence; identical to SEQ ID NO: 173598
  derived and/or modified sequence opt4 from neuraminidase__InfluenzaA__AEQ49782

SEQ ID NO: 173640 - RNA, 1410 nt, Artificial Sequence
  derived and/or modified sequence opt4 from neuraminidase__InfluenzaA__AEQ49783
augaaccccaaccagaagaucaucaccaucggcagcgccugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173641 - RNA, 1410 nt, Artificial Sequence
  derived and/or modified sequence opt4 from neuraminidase__InfluenzaA__AEQ49785
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagcaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173642 - RNA, 1410 nt, Artificial Sequence; identical to SEQ ID NO: 173641
  derived and/or modified sequence opt4 from neuraminidase__InfluenzaA__AEQ49786

SEQ ID NO: 173643 - RNA, 1410 nt, Artificial Sequence; identical to SEQ ID NO: 173641
  derived and/or modified sequence opt4 from neuraminidase__InfluenzaA__AEQ49788

SEQ ID NO: 173644 - RNA, 1410 nt, Artificial Sequence; identical to SEQ ID NO: 173641
  derived and/or modified sequence opt4 from neuraminidase__InfluenzaA__AEQ49789

SEQ ID NO: 173645 - RNA, 1410 nt, Artificial Sequence
  derived and/or modified sequence opt4 from neuraminidase__InfluenzaA__AEQ49790
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173646 - RNA, 1410 nt, Artificial Sequence
  derived and/or modified sequence opt4 from neuraminidase__InfluenzaA__AEQ49791
augaaccccaaccagaagaucaucaccaucggcagcgugagccugaccaucagcaccaucugcuucuucaugcagaucgccauccugaucaccaccgugacccugcacuucaagcaguacgaguucuaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173647 - RNA, 1410 nt, Artificial Sequence; identical to SEQ ID NO: 173641
  derived and/or modified sequence opt4 from neuraminidase__InfluenzaA__AEQ49792

SEQ ID NO: 173648 - RNA, 1410 nt, Artificial Sequence; identical to SEQ ID NO: 173641
  derived and/or modified sequence opt4 from neuraminidase__InfluenzaA__AEQ49793

SEQ ID NO: 173649 - RNA, 1410 nt, Artificial Sequence; identical to SEQ ID NO: 173641
  derived and/or modified sequence opt4 from neuraminidase__InfluenzaA__AEQ49794

SEQ ID NO: 173650 - RNA, 1410 nt, Artificial Sequence; identical to SEQ ID NO: 173641
  derived and/or modified sequence opt4 from neuraminidase__InfluenzaA__AEQ49795

SEQ ID NO: 173651 - RNA, 1410 nt, Artificial Sequence
  derived and/or modified sequence opt4 from neuraminidase__InfluenzaA__AEQ49796
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173652 - RNA, 1410 nt, Artificial Sequence; identical to SEQ ID NO: 173641
  derived and/or modified sequence opt4 from neuraminidase__InfluenzaA__AEQ49797

SEQ ID NO: 173653 - RNA, 1410 nt, Artificial Sequence; identical to SEQ ID NO: 173641
  derived and/or modified sequence opt4 from neuraminidase__InfluenzaA__AEQ49798

SEQ ID NO: 173654 - RNA, 1410 nt, Artificial Sequence; identical to SEQ ID NO: 173641
  derived and/or modified sequence opt4 from neuraminidase__InfluenzaA__AEQ49799

SEQ ID NO: 173655 - RNA, 1410 nt, Artificial Sequence; identical to SEQ ID NO: 173641
  derived and/or modified sequence opt4 from neuraminidase__InfluenzaA__AEQ49800

SEQ ID NO: 173656 - RNA, 1410 nt, Artificial Sequence; identical to SEQ ID NO: 173641
  derived and/or modified sequence opt4 from neuraminidase__InfluenzaA__AEQ49801

SEQ ID NO: 173657 - RNA, 1410 nt, Artificial Sequence; identical to SEQ ID NO: 173641
  derived and/or modified sequence opt4 from neuraminidase__InfluenzaA__AEQ49802

SEQ ID NO: 173658 - RNA, 1410 nt, Artificial Sequence
  derived and/or modified sequence opt4 from neuraminidase__InfluenzaA__AEQ49803
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcaccagcagcagccacugccuggaccccaacaacgaggagggcggccacggcgugaagggcugggccuucgacgacggcaacgacguguggaugggcagaaccaucagcgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugaccaucuga

SEQ ID NO: 173659 - RNA, 1410 nt, Artificial Sequence
  derived and/or modified sequence opt4 from neuraminidase__InfluenzaA__AEQ49804
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173660 - RNA, 1410 nt, Artificial Sequence
  derived and/or modified sequence opt4 from neuraminidase__InfluenzaA__AEQ49805
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173661 - RNA, 1410 nt, Artificial Sequence
  derived and/or modified sequence opt4 from neuraminidase__InfluenzaA__AEQ49806
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173662 - RNA, 1410 nt, Artificial Sequence; identical to SEQ ID NO: 172038
  derived and/or modified sequence opt4 from neuraminidase__InfluenzaA__AEQ49807

SEQ ID NO: 173663 - RNA, 1410 nt, Artificial Sequence
  derived and/or modified sequence opt4 from neuraminidase__InfluenzaA__AEQ49809
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173664 - RNA, 1410 nt, Artificial Sequence; identical to SEQ ID NO: 173663
  derived and/or modified sequence opt4 from neuraminidase__InfluenzaA__AEQ49811

SEQ ID NO: 173665 - RNA, 1410 nt, Artificial Sequence; identical to SEQ ID NO: 172038
  derived and/or modified sequence opt4 from neuraminidase__InfluenzaA__AEQ49812

SEQ ID NO: 173666 - RNA, 1410 nt, Artificial Sequence; identical to SEQ ID NO: 172038
  derived and/or modified sequence opt4 from neuraminidase__InfluenzaA__AEQ49813

SEQ ID NO: 173667 - RNA, 1410 nt, Artificial Sequence; identical to SEQ ID NO: 172038
  derived and/or modified sequence opt4 from neuraminidase__InfluenzaA__AEQ49815

SEQ ID NO: 173668 - RNA, 1410 nt, Artificial Sequence
  derived and/or modified sequence opt4 from neuraminidase__InfluenzaA__AEQ49816
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucguggaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173669 - RNA, 1410 nt, Artificial Sequence; identical to SEQ ID NO: 173403
  derived and/or modified sequence opt4 from neuraminidase__InfluenzaA__AEQ49820

SEQ ID NO: 173670 - RNA, 1410 nt, Artificial Sequence; identical to SEQ ID NO: 173403
  derived and/or modified sequence opt4 from neuraminidase__InfluenzaA__AEQ49821

SEQ ID NO: 173671 - RNA, 1410 nt, Artificial Sequence; identical to SEQ ID NO: 173641
  derived and/or modified sequence opt4 from neuraminidase__InfluenzaA__AEQ49822

SEQ ID NO: 173672 - RNA, 1410 nt, Artificial Sequence; identical to SEQ ID NO: 173641
  derived and/or modified sequence opt4 from neuraminidase__InfluenzaA__AEQ49823

SEQ ID NO: 173673 - RNA, 1410 nt, Artificial Sequence; identical to SEQ ID NO: 173641
  derived and/or modified sequence opt4 from neuraminidase__InfluenzaA__AEQ49824

SEQ ID NO: 173674 - RNA, 1410 nt, Artificial Sequence; identical to SEQ ID NO: 173641
  derived and/or modified sequence opt4 from neuraminidase__InfluenzaA__AEQ49825

SEQ ID NO: 173675 - RNA, 1410 nt, Artificial Sequence; identical to SEQ ID NO: 173641
  derived and/or modified sequence opt4 from neuraminidase__InfluenzaA__AEQ49826

SEQ ID NO: 173676 - RNA, 1410 nt, Artificial Sequence; identical to SEQ ID NO: 173641
  derived and/or modified sequence opt4 from neuraminidase__InfluenzaA__AEQ49827

SEQ ID NO: 173677 - RNA, 1410 nt, Artificial Sequence; identical to SEQ ID NO: 173641
  derived and/or modified sequence opt4 from neuraminidase__InfluenzaA__AEQ49828

SEQ ID NO: 173678 - RNA, 1410 nt, Artificial Sequence
  derived and/or modified sequence opt4 from neuraminidase__InfluenzaA__AEQ49829
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgcccugggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagcaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173679 - RNA, 1410 nt, Artificial Sequence; identical to SEQ ID NO: 173641
  derived and/or modified sequence opt4 from neuraminidase__InfluenzaA__AEQ49830

SEQ ID NO: 173680 - RNA, 1410 nt, Artificial Sequence; identical to SEQ ID NO: 173641
  derived and/or modified sequence opt4 from neuraminidase__InfluenzaA__AEQ49831

SEQ ID NO: 173681 - RNA, 1410 nt, Artificial Sequence
  derived and/or modified sequence opt4 from neuraminidase__InfluenzaA__AEQ49832
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugguggagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagcaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173682 - RNA, 1410 nt, Artificial Sequence
  derived and/or modified sequence opt4 from neuraminidase__InfluenzaA__AEQ49833
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucagcagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173683 - RNA, 1410 nt, Artificial Sequence
  derived and/or modified sequence opt4 from neuraminidase__InfluenzaA__AEQ49835
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173684 - RNA, 1410 nt, Artificial Sequence; identical to SEQ ID NO: 173683
  derived and/or modified sequence opt4 from neuraminidase__InfluenzaA__AEQ49836

SEQ ID NO: 173685 - RNA, 1410 nt, Artificial Sequence; identical to SEQ ID NO: 173683
  derived and/or modified sequence opt4 from neuraminidase__InfluenzaA__AEQ49838

SEQ ID NO: 173686 - RNA, 1410 nt, Artificial Sequence; identical to SEQ ID NO: 173683
  derived and/or modified sequence opt4 from neuraminidase__InfluenzaA__AEQ49839

SEQ ID NO: 173687 - RNA, 1410 nt, Artificial Sequence
  derived and/or modified sequence opt4 from neuraminidase__InfluenzaA__AEQ49840
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173688 - RNA, 1410 nt, Artificial Sequence; identical to SEQ ID NO: 173683
  derived and/or modified sequence opt4 from neuraminidase__InfluenzaA__AEQ49841

SEQ ID NO: 173689 - RNA, 1410 nt, Artificial Sequence; identical to SEQ ID NO: 173683
  derived and/or modified sequence opt4 from neuraminidase__InfluenzaA__AEQ49842

SEQ ID NO: 173690 - RNA, 1410 nt, Artificial Sequence; identical to SEQ ID NO: 173683
  derived and/or modified sequence opt4 from neuraminidase__InfluenzaA__AEQ49843

SEQ ID NO: 173691 - RNA, 1410 nt, Artificial Sequence; identical to SEQ ID NO: 173641
  derived and/or modified sequence opt4 from neuraminidase__InfluenzaA__AEQ49844

SEQ ID NO: 173692 - RNA, 1410 nt, Artificial Sequence
  derived and/or modified sequence opt4 from neuraminidase__InfluenzaA__AEQ49845
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagagagagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173693 - RNA, 1410 nt, Artificial Sequence
  derived and/or modified sequence opt4 from neuraminidase__InfluenzaA__AEQ49846
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaaccugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173694 - RNA, 1410 nt, Artificial Sequence
  derived and/or modified sequence opt4 from neuraminidase__InfluenzaA__AEQ49850
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagcaaggaggagaccgaggugcuguggaccagcaacagcaucgugguguucugcggcaccagcggcaccuacggcaccggcagcuggcccgacggcgccgacaucaagaucaugcccaucuga

SEQ ID NO: 173695 - RNA, 1410 nt, Artificial Sequence
  derived and/or modified sequence opt4 from neuraminidase__InfluenzaA__AEQ49851
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucauggagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173696 - RNA, 1410 nt, Artificial Sequence; identical to SEQ ID NO: 173663
  derived and/or modified sequence opt4 from neuraminidase__InfluenzaA__AEQ49852

SEQ ID NO: 173697 - RNA, 1410 nt, Artificial Sequence; identical to SEQ ID NO: 173641
  derived and/or modified sequence opt4 from neuraminidase__InfluenzaA__AEQ49969

SEQ ID NO: 173698 - RNA, 1410 nt, Artificial Sequence; identical to SEQ ID NO: 173663
  derived and/or modified sequence opt4 from neuraminidase__InfluenzaA__AEQ49970

SEQ ID NO: 173699 - RNA, 1410 nt, Artificial Sequence
  derived and/or modified sequence opt4 from neuraminidase__InfluenzaA__AEQ54954
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173700 - RNA, 1410 nt, Artificial Sequence; identical to SEQ ID NO: 169119
  derived and/or modified sequence opt4 from neuraminidase__InfluenzaA__AER08645

SEQ ID NO: 173701 - RNA, 1410 nt, Artificial Sequence
  derived and/or modified sequence opt4 from neuraminidase__InfluenzaA__AER08649
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagcuggugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173702 - RNA, 1410 nt, Artificial Sequence
  derived and/or modified sequence opt4 from neuraminidase__InfluenzaA__AER08657
augaaccccaaccagaagaucaucaccaucggcagcgugagccugaccaucagcaccgugugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173703 - RNA, 1410 nt, Artificial Sequence; identical to SEQ ID NO: 169119
  derived and/or modified sequence opt4 from neuraminidase__InfluenzaA__AER08659

SEQ ID NO: 173704 - RNA, 1410 nt, Artificial Sequence
  derived and/or modified sequence opt4 from neuraminidase__InfluenzaA__AER08661
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcgaccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173705 - RNA, 1410 nt, Artificial Sequence; identical to SEQ ID NO: 172038
  derived and/or modified sequence opt4 from neuraminidase__InfluenzaA__AER08663

SEQ ID NO: 173706 - RNA, 1410 nt, Artificial Sequence; identical to SEQ ID NO: 172038
  derived and/or modified sequence opt4 from neuraminidase__InfluenzaA__AER08665

SEQ ID NO: 173707 - RNA, 1410 nt, Artificial Sequence
  derived and/or modified sequence opt4 from neuraminidase__InfluenzaA__AER08669
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccacccuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173708 - RNA, 1410 nt, Artificial Sequence
  derived and/or modified sequence opt4 from neuraminidase__InfluenzaA__AER08671
augaaccccaaccagaagaucaucaccaucggcagcgugagccugaccaucagcaccaucugcuucuucaugcagaucgccauccugaucaccaccgugacccugcacuucaagcaguacggcuucaacagcccccccaacaaccaggugaugcugugcgagcccaccaucaucgagagaaacaucaccgagaucguguaccugaccaacaccaccaucgagaaggagaucugccccacccuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173709 - RNA, 1410 nt, Artificial Sequence; identical to SEQ ID NO: 172038
  derived and/or modified sequence opt4 from neuraminidase__InfluenzaA__AER08673

SEQ ID NO: 173710 - RNA, 1410 nt, Artificial Sequence; identical to SEQ ID NO: 172038
  derived and/or modified sequence opt4 from neuraminidase__InfluenzaA__AER08675

SEQ ID NO: 173711 - RNA, 1410 nt, Artificial Sequence; identical to SEQ ID NO: 172038
  derived and/or modified sequence opt4 from neuraminidase__InfluenzaA__AER08677

SEQ ID NO: 173712 - RNA, 1410 nt, Artificial Sequence; identical to SEQ ID NO: 172038
  derived and/or modified sequence opt4 from neuraminidase__InfluenzaA__AER08679

SEQ ID NO: 173713 - RNA, 1410 nt, Artificial Sequence
  derived and/or modified sequence opt4 from neuraminidase__InfluenzaA__AER08681
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacgacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173714 - RNA, 1410 nt, Artificial Sequence; identical to SEQ ID NO: 172038
  derived and/or modified sequence opt4 from neuraminidase__InfluenzaA__AER08683

SEQ ID NO: 173715 - RNA, 1410 nt, Artificial Sequence; identical to SEQ ID NO: 173663
  derived and/or modified sequence opt4 from neuraminidase__InfluenzaA__AER08685

SEQ ID NO: 173716 - RNA, 1410 nt, Artificial Sequence; identical to SEQ ID NO: 173663
  derived and/or modified sequence opt4 from neuraminidase__InfluenzaA__AER08687

SEQ ID NO: 173717 - RNA, 1410 nt, Artificial Sequence
  derived and/or modified sequence opt4 from neuraminidase__InfluenzaA__AER08689
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugacccugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaaggacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173718 - RNA, 1410 nt, Artificial Sequence; identical to SEQ ID NO: 173663
  derived and/or modified sequence opt4 from neuraminidase__InfluenzaA__AER08691

SEQ ID NO: 173719 - RNA, 1410 nt, Artificial Sequence
  derived and/or modified sequence opt4 from neuraminidase__InfluenzaA__AER08693
augaaccccaaccagaagaucaucaccaucggcagcgugagccugaccaucagcaccaucugcuucuucaugcagaucgccauccugaucaccaccgugacccugcacuucaagcaguacgaguucaacagcccccccaagaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173720 - RNA, 1410 nt, Artificial Sequence
  derived and/or modified sequence opt4 from neuraminidase__InfluenzaA__AER08697
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaccugccccacccuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgugaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 173721 - RNA, 1410 nt, Artificial Sequence; identical to SEQ ID NO: 173517
  derived and/or modified sequence opt4 from neuraminidase__InfluenzaA__AER92714

SEQ ID NO: 173722 - RNA, 1410 nt, Artificial Sequence; identical to SEQ ID NO: 169258
  derived and/or modified sequence opt4 from neuraminidase__InfluenzaA__AER92721

SEQ ID NO: 173723 - RNA, 1410 nt, Artificial Sequence; identical to SEQ ID NO: 169258
  derived and/or modified sequence opt4 from neuraminidase__InfluenzaA__AER92724

SEQ ID NO: 173724 - RNA, 1413 nt, Artificial Sequence
  derived and/or modified sequence opt4 from neuraminidase__InfluenzaA__AET84165
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugagcgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccaucgacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173725 - RNA, 1413 nt, Artificial Sequence; identical to SEQ ID NO: 171450
  derived and/or modified sequence opt4 from neuraminidase__InfluenzaA__AET84176

SEQ ID NO: 173726 - RNA, 1413 nt, Artificial Sequence
  derived and/or modified sequence opt4 from neuraminidase__InfluenzaA__AET84187
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcauggacuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccaucgacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173727 - RNA, 1413 nt, Artificial Sequence
  derived and/or modified sequence opt4 from neuraminidase__InfluenzaA__AET84198
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcaugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173728 - RNA, 1413 nt, Artificial Sequence
  derived and/or modified sequence opt4 from neuraminidase__InfluenzaA__AET84209
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaaggugguggccggcgaggacaagaccagcgugacccuggccggcaacagcagccugugcagcaucagcggcugggccaucaacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173729 - RNA, 1413 nt, Artificial Sequence
  derived and/or modified sequence opt4 from neuraminidase__InfluenzaA__AET84231
augaaccccaaccagaagaucaucaccaucggcagcaucagcaucgccaucggcaucaucagccugaugcugcagaucggcagcaucaucagcaucugggccagccacagcauccacaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccagcagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173730 - RNA, 1413 nt, Artificial Sequence; identical to SEQ ID NO: 169981
  derived and/or modified sequence opt4 from neuraminidase__InfluenzaA__AET84242

SEQ ID NO: 173731 - RNA, 1413 nt, Artificial Sequence
  derived and/or modified sequence opt4 from neuraminidase__InfluenzaA__AET84253
augaaccccaaccagaagaucaucaccaucggcagcaucagcaucgccaucggcaucaucagccugaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173732 - RNA, 1413 nt, Artificial Sequence
  derived and/or modified sequence opt4 from neuraminidase__InfluenzaA__AET84264
augaaccccaaccagaagaucaucaccaucggcagcaucagcaucgccaucggcaucaucagccugauguuccagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173733 - RNA, 1413 nt, Artificial Sequence
  derived and/or modified sequence opt4 from neuraminidase__InfluenzaA__AET84275
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173734 - RNA, 1413 nt, Artificial Sequence; identical to SEQ ID NO: 169981
  derived and/or modified sequence opt4 from neuraminidase__InfluenzaA__AET84286

SEQ ID NO: 173735 - RNA, 1413 nt, Artificial Sequence
  derived and/or modified sequence opt4 from neuraminidase__InfluenzaA__AET84297
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccaccaacuggagcuggcccgacggcgccgagcugcccuucaccaucgacaaguga

SEQ ID NO: 173736 - RNA, 1413 nt, Artificial Sequence
  derived and/or modified sequence opt4 from neuraminidase__InfluenzaA__AET84308
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccaccaacuggagcuggcccgacggcgccgagcugcccuucaccaucgacaaguga

SEQ ID NO: 173737 - RNA, 1413 nt, Artificial Sequence
  derived and/or modified sequence opt4 from neuraminidase__InfluenzaA__AET84319
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcaugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacagaaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173738 - RNA, 1413 nt, Artificial Sequence
  derived and/or modified sequence opt4 from neuraminidase__InfluenzaA__AET84330
augaaccccaaccagagaaucaucaccaucggcagcaucagcaucgccaucggcaucaucagccugaugcugcagaucggcaacaucaucagcaucugggccagccacagcauccagaucggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173739 - RNA, 1413 nt, Artificial Sequence
  derived and/or modified sequence opt4 from neuraminidase__InfluenzaA__AET84341
augaaccccaaccagagaaucaucaccaucggcagcaucagcaucgccaucggcaucaucagccugaugcugcagaucggcaacaucaucagcaucugggccagccacagcauccagaucggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 173740 - RNA, 1413 nt, Artificial Sequence
  derived and/or modified sequence opt4 from neuraminidase__InfluenzaA__AET84363
augaaccccaaccagagaaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcaugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173741 - RNA, 1413 nt, Artificial Sequence
  derived and/or modified sequence opt4 from neuraminidase__InfluenzaA__AET84374
augaaccccaaccagagaaucaucaccaucggcagcaucagcaucgccaucggcaucaucagccugaugcugcagaucggcaacaucaucagcaucugggccagccacagcauccagaucggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173742 - RNA, 1413 nt, Artificial Sequence
  derived and/or modified sequence opt4 from neuraminidase__InfluenzaA__AET84396
augaaccccaaccagagaaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcaugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173743 - RNA, 1413 nt, Artificial Sequence
  derived and/or modified sequence opt4 from neuraminidase__InfluenzaA__AET84407
augaaccccaaccagagaaucaucaccaucggcagcaucagcaucgccaucggcaucaucagccugaugcugcagaucggcaacaucaucagcaucugggccagccacagcauccagaucggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173744 - RNA, 1413 nt, Artificial Sequence
  derived and/or modified sequence opt4 from neuraminidase__InfluenzaA__AET84418
augaaccccaaccagagaaucaucgccaucggcagcaucagcaucgccaucggcaucaucagccugaugcugcagaucggcaacaucaucagcaucugggccagccacagcauccagaucggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173745 - RNA, 1413 nt, Artificial Sequence
  derived and/or modified sequence opt4 from neuraminidase__InfluenzaA__AET84429
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccaggaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173746 - RNA, 1413 nt, Artificial Sequence
  derived and/or modified sequence opt4 from neuraminidase__InfluenzaA__AET84440
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173747 - RNA, 1413 nt, Artificial Sequence
  derived and/or modified sequence opt4 from neuraminidase__InfluenzaA__AET84451
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugaccaagggcgcccugcugaacgacaagcacagcaacggcaccgugaccgacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 173748 - RNA, 1410 nt, Artificial Sequence; identical to SEQ ID NO: 169258
  derived and/or modified sequence opt4 from neuraminidase__InfluenzaA__AEV53421

SEQ ID NO: 173749 - RNA, 1410 nt, Artificial Sequence; identical to SEQ ID NO: 169258
  derived and/or modified sequence opt4 from neuraminidase__InfluenzaA__AEV53423

SEQ ID NO: 173750 - RNA, 1410 nt, Artificial Sequence; identical to SEQ ID NO: 170720
  derived and/or modified sequence opt4 from neuraminidase__InfluenzaA__AEV53425

SEQ ID NO: 173751 - RNA, 1410 nt, Artificial Sequence; identical to SEQ ID NO: 169258
  derived and/or modified sequence opt4 from neuraminidase__InfluenzaA__AEV53427

SEQ ID NO: 173752 - RNA, 1410 nt, Artificial Sequence; identical to SEQ ID NO: 170720
  derived and/or modified sequence opt4 from neuraminidase__InfluenzaA__AEV53429

SEQ ID NO: 173753 - RNA, 1410 nt, Artificial Sequence
  derived and/or modified sequence opt4 from neuraminidase__InfluenzaA__AEV53431
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 173754 - RNA, 1410 nt, Artificial Sequence; identical to SEQ ID NO: 169258
  derived and/or modified sequence opt4 from neuraminidase__InfluenzaA__AEV53435

SEQ ID NO: 173755 - RNA, 1410 nt, Artificial Sequence
  derived and/or modified sequence opt4 from neuraminidase__InfluenzaA__AEV53437
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacacccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173756 - RNA, 1410 nt, Artificial Sequence; identical to SEQ ID NO: 169258
  derived and/or modified sequence opt4 from neuraminidase__InfluenzaA__AEV53439

SEQ ID NO: 173757 - RNA, 1410 nt, Artificial Sequence; identical to SEQ ID NO: 169258
  derived and/or modified sequence opt4 from neuraminidase__InfluenzaA__AEV53441

SEQ ID NO: 173758 - RNA, 1410 nt, Artificial Sequence; identical to SEQ ID NO: 169258
  derived and/or modified sequence opt4 from neuraminidase__InfluenzaA__AEV53443

SEQ ID NO: 173759 - RNA, 1410 nt, Artificial Sequence
  derived and/or modified sequence opt4 from neuraminidase__InfluenzaA__AEV53445
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgaccacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173760 - RNA, 1410 nt, Artificial Sequence; identical to SEQ ID NO: 169258
  derived and/or modified sequence opt4 from neuraminidase__InfluenzaA__AEV53447

SEQ ID NO: 173761 - RNA, 1410 nt, Artificial Sequence; identical to SEQ ID NO: 171160
  derived and/or modified sequence opt4 from neuraminidase__InfluenzaA__AEV53449

SEQ ID NO: 173762 - RNA, 1410 nt, Artificial Sequence
  derived and/or modified sequence opt4 from neuraminidase__InfluenzaA__AEV53451
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccgacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173763 - RNA, 1410 nt, Artificial Sequence; identical to SEQ ID NO: 169258
  derived and/or modified sequence opt4 from neuraminidase__InfluenzaA__AEV53453

SEQ ID NO: 173764 - RNA, 1410 nt, Artificial Sequence
  derived and/or modified sequence opt4 from neuraminidase__InfluenzaA__AEV53455
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacaacuucagcaucaagcaggacaucgugggcaucaacgaguggagcggcuacagcggcagcuucgugcagcaccccgagcugaccggccugaacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173765 - RNA, 1410 nt, Artificial Sequence
  derived and/or modified sequence opt4 from neuraminidase__InfluenzaA__AEV53457
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaguggagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173766 - RNA, 1410 nt, Artificial Sequence
  derived and/or modified sequence opt4 from neuraminidase__InfluenzaA__AEV53459
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaucaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacaacuucagcaucaagcaggacaucgugggcaucaacgaguggagcggcuacagcggcagcuucgugcagcaccccgagcugaccggccugaacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173767 - RNA, 1410 nt, Artificial Sequence; identical to SEQ ID NO: 169258
  derived and/or modified sequence opt4 from neuraminidase__InfluenzaA__AEV53461

SEQ ID NO: 173768 - RNA, 1410 nt, Artificial Sequence
  derived and/or modified sequence opt4 from neuraminidase__InfluenzaA__AEV53463
augaaccccaaccagaagaucaucaccaucggcagcgugugcaugaccaucggcauggccaaccugauccugcagaucggcaacaucaucagcaucuggaucagccacagcauccagcuggagaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcaucaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173769 - RNA, 1410 nt, Artificial Sequence
  derived and/or modified sequence opt4 from neuraminidase__InfluenzaA__AEV53465
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacagacaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuacaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173770 - RNA, 1410 nt, Artificial Sequence; identical to SEQ ID NO: 171059
  derived and/or modified sequence opt4 from neuraminidase__InfluenzaA__AEV53467

SEQ ID NO: 173771 - RNA, 1410 nt, Artificial Sequence; identical to SEQ ID NO: 171059
  derived and/or modified sequence opt4 from neuraminidase__InfluenzaA__AEV53469

SEQ ID NO: 173772 - RNA, 1410 nt, Artificial Sequence; identical to SEQ ID NO: 169258
  derived and/or modified sequence opt4 from neuraminidase__InfluenzaA__AEV53471

SEQ ID NO: 173773 - RNA, 1410 nt, Artificial Sequence; identical to SEQ ID NO: 169258
  derived and/or modified sequence opt4 from neuraminidase__InfluenzaA__AEV53473

SEQ ID NO: 173774 - RNA, 1410 nt, Artificial Sequence; identical to SEQ ID NO: 169258
  derived and/or modified sequence opt4 from neuraminidase__InfluenzaA__AEV53475

SEQ ID NO: 173775 - RNA, 1410 nt, Artificial Sequence; identical to SEQ ID NO: 169258
  derived and/or modified sequence opt4 from neuraminidase__InfluenzaA__AEV53477

SEQ ID NO: 173776 - RNA, 1410 nt, Artificial Sequence; identical to SEQ ID NO: 169258
  derived and/or modified sequence opt4 from neuraminidase__InfluenzaA__AEV53479

SEQ ID NO: 173777 - RNA, 1410 nt, Artificial Sequence; identical to SEQ ID NO: 169258
  derived and/or modified sequence opt4 from neuraminidase__InfluenzaA__AEV53481

SEQ ID NO: 173778 - RNA, 1410 nt, Artificial Sequence; identical to SEQ ID NO: 169258
  derived and/or modified sequence opt4 from neuraminidase__InfluenzaA__AEV53483

SEQ ID NO: 173779 - RNA, 1410 nt, Artificial Sequence
  derived and/or modified sequence opt4 from neuraminidase__InfluenzaA__AEV53485
augaaccccaaccagaagaucaucaccaucggcagcgugugcaugaccaucggcauggccaaccugauccugcagaucggcaacaucaucagcaucugggugagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173780 - RNA, 1410 nt, Artificial Sequence; identical to SEQ ID NO: 171059
  derived and/or modified sequence opt4 from neuraminidase__InfluenzaA__AEV53487

SEQ ID NO: 173781 - RNA, 1410 nt, Artificial Sequence; identical to SEQ ID NO: 170276
  derived and/or modified sequence opt4 from neuraminidase__InfluenzaA__AEV53489

SEQ ID NO: 173782 - RNA, 1410 nt, Artificial Sequence
  derived and/or modified sequence opt4 from neuraminidase__InfluenzaA__AEV53491
augaaccccaaccagaagaucaucaccaucggccuggugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173783 - RNA, 1410 nt, Artificial Sequence; identical to SEQ ID NO: 169258
  derived and/or modified sequence opt4 from neuraminidase__InfluenzaA__AEV53493

SEQ ID NO: 173784 - RNA, 1410 nt, Artificial Sequence; identical to SEQ ID NO: 170720
  derived and/or modified sequence opt4 from neuraminidase__InfluenzaA__AEV53495

SEQ ID NO: 173785 - RNA, 1410 nt, Artificial Sequence
  derived and/or modified sequence opt4 from neuraminidase__InfluenzaA__AEV53497
augaaccccaaccagaagaucaucaccaucggcagcgugugcaugaccaucggcauggccaaccugauccugcagaucggcaacaucaucagcaucuggaucagccacagcauccagcuggagaaccagaaccagaucgagaccugcaaccagagcgugaucaccuacgagaacaacaccugggugaaccagaccuacgugaacaucagcaacaccaacuucgccgccggccagagcguggugagcgugaaccuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173786 - RNA, 1410 nt, Artificial Sequence; identical to SEQ ID NO: 170276
  derived and/or modified sequence opt4 from neuraminidase__InfluenzaA__AEV53499

SEQ ID NO: 173787 - RNA, 1410 nt, Artificial Sequence; identical to SEQ ID NO: 169258
  derived and/or modified sequence opt4 from neuraminidase__InfluenzaA__AEV53501

SEQ ID NO: 173788 - RNA, 1410 nt, Artificial Sequence; identical to SEQ ID NO: 169258
  derived and/or modified sequence opt4 from neuraminidase__InfluenzaA__AEV53503

SEQ ID NO: 173789 - RNA, 1410 nt, Artificial Sequence; identical to SEQ ID NO: 169258
  derived and/or modified sequence opt4 from neuraminidase__InfluenzaA__AEV53505

SEQ ID NO: 173790 - RNA, 1410 nt, Artificial Sequence; identical to SEQ ID NO: 169258
  derived and/or modified sequence opt4 from neuraminidase__InfluenzaA__AEV53507

SEQ ID NO: 173791 - RNA, 1410 nt, Artificial Sequence; identical to SEQ ID NO: 169258
  derived and/or modified sequence opt4 from neuraminidase__InfluenzaA__AEV53509

SEQ ID NO: 173792 - RNA, 1410 nt, Artificial Sequence; identical to SEQ ID NO: 170720
  derived and/or modified sequence opt4 from neuraminidase__InfluenzaA__AEV53511

SEQ ID NO: 173793 - RNA, 1410 nt, Artificial Sequence; identical to SEQ ID NO: 170720
  derived and/or modified sequence opt4 from neuraminidase__InfluenzaA__AEV53513

SEQ ID NO: 173794 - RNA, 1410 nt, Artificial Sequence; identical to SEQ ID NO: 170720
  derived and/or modified sequence opt4 from neuraminidase__InfluenzaA__AEV53515

SEQ ID NO: 173795 - RNA, 1410 nt, Artificial Sequence
  derived and/or modified sequence opt4 from neuraminidase__InfluenzaA__AEV53517
augaaccccaaccagagaaucaucaccaucggcagcgugugcaugaccaucggcauggccaaccugauccugcagaucggcaacaucaucagcaucugggugagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173796 - RNA, 1410 nt, Artificial Sequence; identical to SEQ ID NO: 169258
  derived and/or modified sequence opt4 from neuraminidase__InfluenzaA__AEV53519

SEQ ID NO: 173797 - RNA, 1410 nt, Artificial Sequence; identical to SEQ ID NO: 170720
  derived and/or modified sequence opt4 from neuraminidase__InfluenzaA__AEV53521

SEQ ID NO: 173798 - RNA, 1410 nt, Artificial Sequence; identical to SEQ ID NO: 170546
  derived and/or modified sequence opt4 from neuraminidase__InfluenzaA__AEV53523

SEQ ID NO: 173799 - RNA, 1410 nt, Artificial Sequence; identical to SEQ ID NO: 169612
  derived and/or modified sequence opt4 from neuraminidase__InfluenzaA__AEV53525

SEQ ID NO: 173800 - RNA, 1410 nt, Artificial Sequence; identical to SEQ ID NO: 169258
  derived and/or modified sequence opt4 from neuraminidase__InfluenzaA__AEV53527

SEQ ID NO: 173801 - RNA, 1410 nt, Artificial Sequence
  derived and/or modified sequence opt4 from neuraminidase__InfluenzaA__AEV53529
augaaccccaaccagaagaucaucaccaucggcagcgugugcaugaccaucggcauggccaaccugauccugcagaucggcaacaucaucagcaucuggaucagccacagcauccagcuggagaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173802 - RNA, 1410 nt, Artificial Sequence; identical to SEQ ID NO: 170720
  derived and/or modified sequence opt4 from neuraminidase__InfluenzaA__AEV53531

SEQ ID NO: 173803 - RNA, 1410 nt, Artificial Sequence
  derived and/or modified sequence opt4 from neuraminidase__InfluenzaA__AEV53533
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccugaacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173804 - RNA, 1410 nt, Artificial Sequence; identical to SEQ ID NO: 169258
  derived and/or modified sequence opt4 from neuraminidase__InfluenzaA__AEV53535

SEQ ID NO: 173805 - RNA, 1410 nt, Artificial Sequence; identical to SEQ ID NO: 173779
  derived and/or modified sequence opt4 from neuraminidase__InfluenzaA__AEV53537

SEQ ID NO: 173806 - RNA, 1410 nt, Artificial Sequence; identical to SEQ ID NO: 169258
  derived and/or modified sequence opt4 from neuraminidase__InfluenzaA__AEV53539

SEQ ID NO: 173807 - RNA, 1410 nt, Artificial Sequence; identical to SEQ ID NO: 172697
  derived and/or modified sequence opt4 from neuraminidase__InfluenzaA__AEV53541

SEQ ID NO: 173808 - RNA, 1410 nt, Artificial Sequence; identical to SEQ ID NO: 172697
  derived and/or modified sequence opt4 from neuraminidase__InfluenzaA__AEV53543

SEQ ID NO: 173809 - RNA, 1410 nt, Artificial Sequence; identical to SEQ ID NO: 170906
  derived and/or modified sequence opt4 from neuraminidase__InfluenzaA__AEV53545

SEQ ID NO: 173810 - RNA, 1410 nt, Artificial Sequence; identical to SEQ ID NO: 172697
  derived and/or modified sequence opt4 from neuraminidase__InfluenzaA__AEV53547

SEQ ID NO: 173811 - RNA, 1410 nt, Artificial Sequence; identical to SEQ ID NO: 172697
  derived and/or modified sequence opt4 from neuraminidase__InfluenzaA__AEV53549

SEQ ID NO: 173812 - RNA, 1410 nt, Artificial Sequence; identical to SEQ ID NO: 172697
  derived and/or modified sequence opt4 from neuraminidase__InfluenzaA__AEV53551

SEQ ID NO: 173813 - RNA, 1410 nt, Artificial Sequence; identical to SEQ ID NO: 172697
  derived and/or modified sequence opt4 from neuraminidase__InfluenzaA__AEV53553

SEQ ID NO: 173814 - RNA, 1410 nt, Artificial Sequence; identical to SEQ ID NO: 173779
  derived and/or modified sequence opt4 from neuraminidase__InfluenzaA__AEV53555

SEQ ID NO: 173815 - RNA, 1410 nt, Artificial Sequence; identical to SEQ ID NO: 170276
  derived and/or modified sequence opt4 from neuraminidase__InfluenzaA__AEV53557

SEQ ID NO: 173816 - RNA, 1410 nt, Artificial Sequence; identical to SEQ ID NO: 169258
  derived and/or modified sequence opt4 from neuraminidase__InfluenzaA__AEV53559

SEQ ID NO: 173817 - RNA, 1410 nt, Artificial Sequence; identical to SEQ ID NO: 169258
  derived and/or modified sequence opt4 from neuraminidase__InfluenzaA__AEV53561

SEQ ID NO: 173818 - RNA, 1410 nt, Artificial Sequence; identical to SEQ ID NO: 170850
  derived and/or modified sequence opt4 from neuraminidase__InfluenzaA__AEV53563

SEQ ID NO: 173819 - RNA, 1410 nt, Artificial Sequence
  derived and/or modified sequence opt4 from neuraminidase__InfluenzaA__AEV53565
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugaacggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugccccugaccaucgacaaguga

SEQ ID NO: 173820 - RNA, 1410 nt, Artificial Sequence
  derived and/or modified sequence opt4 from neuraminidase__InfluenzaA__AEV53567
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcgccuggaucggcagaaccaagagcaucagcagcagaaacggcuucgagaugaucugggaccccaacggcuggaccgagaccgacaacaacuucagcaucaagcaggacaucgugggcaucaacgaguggagcggcuacagcggcagcuucgugcagcaccccgagcugaccggccugaacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173821 - RNA, 1410 nt, Artificial Sequence; identical to SEQ ID NO: 169258
  derived and/or modified sequence opt4 from neuraminidase__InfluenzaA__AEV53569

SEQ ID NO: 173822 - RNA, 1410 nt, Artificial Sequence; identical to SEQ ID NO: 172697
  derived and/or modified sequence opt4 from neuraminidase__InfluenzaA__AEV53571

SEQ ID NO: 173823 - RNA, 1410 nt, Artificial Sequence; identical to SEQ ID NO: 172697
  derived and/or modified sequence opt4 from neuraminidase__InfluenzaA__AEV53573

SEQ ID NO: 173824 - RNA, 1410 nt, Artificial Sequence; identical to SEQ ID NO: 171059
  derived and/or modified sequence opt4 from neuraminidase__InfluenzaA__AEV53575

SEQ ID NO: 173825 - RNA, 1410 nt, Artificial Sequence
  derived and/or modified sequence opt4 from neuraminidase__InfluenzaA__AEV53577
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcagcccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173826 - RNA, 1410 nt, Artificial Sequence; identical to SEQ ID NO: 173764
  derived and/or modified sequence opt4 from neuraminidase__InfluenzaA__AEV53579

SEQ ID NO: 173827 - RNA, 1410 nt, Artificial Sequence; identical to SEQ ID NO: 171059
  derived and/or modified sequence opt4 from neuraminidase__InfluenzaA__AEV53581

SEQ ID NO: 173828 - RNA, 1410 nt, Artificial Sequence; identical to SEQ ID NO: 170720
  derived and/or modified sequence opt4 from neuraminidase__InfluenzaA__AEV53583

SEQ ID NO: 173829 - RNA, 1410 nt, Artificial Sequence; identical to SEQ ID NO: 170720
  derived and/or modified sequence opt4 from neuraminidase__InfluenzaA__AEV53585

SEQ ID NO: 173830 - RNA, 1410 nt, Artificial Sequence
  derived and/or modified sequence opt4 from neuraminidase__InfluenzaA__AEV76877
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaccaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173831 - RNA, 1410 nt, Artificial Sequence; identical to SEQ ID NO: 169258
  derived and/or modified sequence opt4 from neuraminidase__InfluenzaA__AEW10576

SEQ ID NO: 173832 - RNA, 1410 nt, Artificial Sequence; identical to SEQ ID NO: 169258
  derived and/or modified sequence opt4 from neuraminidase__InfluenzaA__AEW10586

SEQ ID NO: 173833 - RNA, 1410 nt, Artificial Sequence; identical to SEQ ID NO: 169258
  derived and/or modified sequence opt4 from neuraminidase__InfluenzaA__AEW10596

SEQ ID NO: 173834 - RNA, 1410 nt, Artificial Sequence; identical to SEQ ID NO: 169258
  derived and/or modified sequence opt4 from neuraminidase__InfluenzaA__AEW10606

SEQ ID NO: 173835 - RNA, 1410 nt, Artificial Sequence; identical to SEQ ID NO: 170145
  derived and/or modified sequence opt4 from neuraminidase__InfluenzaA__AEW10616

SEQ ID NO: 173836 - RNA, 1410 nt, Artificial Sequence
  derived and/or modified sequence opt4 from neuraminidase__InfluenzaA__AEW10626
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccauggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173837 - RNA, 1410 nt, Artificial Sequence; identical to SEQ ID NO: 169258
  derived and/or modified sequence opt4 from neuraminidase__InfluenzaA__AEW10636

SEQ ID NO: 173838 - RNA, 1410 nt, Artificial Sequence; identical to SEQ ID NO: 169248
  derived and/or modified sequence opt4 from neuraminidase__InfluenzaA__AEW10646

SEQ ID NO: 173839 - RNA, 1410 nt, Artificial Sequence; identical to SEQ ID NO: 169258
  derived and/or modified sequence opt4 from neuraminidase__InfluenzaA__AEW10656

SEQ ID NO: 173840 - RNA, 1410 nt, Artificial Sequence; identical to SEQ ID NO: 169258
  derived and/or modified sequence opt4 from neuraminidase__InfluenzaA__AEW10666

SEQ ID NO: 173841 - RNA, 1410 nt, Artificial Sequence; identical to SEQ ID NO: 169258
  derived and/or modified sequence opt4 from neuraminidase__InfluenzaA__AEW10676

SEQ ID NO: 173842 - RNA, 1410 nt, Artificial Sequence; identical to SEQ ID NO: 169258
  derived and/or modified sequence opt4 from neuraminidase__InfluenzaA__AEW10686

SEQ ID NO: 173843 - RNA, 1410 nt, Artificial Sequence; identical to SEQ ID NO: 169258
  derived and/or modified sequence opt4 from neuraminidase__InfluenzaA__AEW10696

SEQ ID NO: 173844 - RNA, 1410 nt, Artificial Sequence; identical to SEQ ID NO: 169258
  derived and/or modified sequence opt4 from neuraminidase__InfluenzaA__AEW10706

SEQ ID NO: 173845 - RNA, 1410 nt, Artificial Sequence; identical to SEQ ID NO: 169248
  derived and/or modified sequence opt4 from neuraminidase__InfluenzaA__AEW10716

SEQ ID NO: 173846 - RNA, 1410 nt, Artificial Sequence; identical to SEQ ID NO: 169258
  derived and/or modified sequence opt4 from neuraminidase__InfluenzaA__AEW10726

SEQ ID NO: 173847 - RNA, 1410 nt, Artificial Sequence; identical to SEQ ID NO: 169258
  derived and/or modified sequence opt4 from neuraminidase__InfluenzaA__AEW10736

SEQ ID NO: 173848 - RNA, 1410 nt, Artificial Sequence; identical to SEQ ID NO: 169248
  derived and/or modified sequence opt4 from neuraminidase__InfluenzaA__AEW10746

SEQ ID NO: 173849 - RNA, 1410 nt, Artificial Sequence; identical to SEQ ID NO: 169248
  derived and/or modified sequence opt4 from neuraminidase__InfluenzaA__AEW10756

SEQ ID NO: 173850 - RNA, 1410 nt, Artificial Sequence; identical to SEQ ID NO: 169248
  derived and/or modified sequence opt4 from neuraminidase__InfluenzaA__AEW10766

SEQ ID NO: 173851 - RNA, 1410 nt, Artificial Sequence; identical to SEQ ID NO: 169248
  derived and/or modified sequence opt4 from neuraminidase__InfluenzaA__AEW10776

SEQ ID NO: 173852 - RNA, 1410 nt, Artificial Sequence; identical to SEQ ID NO: 169248
  derived and/or modified sequence opt4 from neuraminidase__InfluenzaA__AEW10786

SEQ ID NO: 173853 - RNA, 1410 nt, Artificial Sequence; identical to SEQ ID NO: 169248
  derived and/or modified sequence opt4 from neuraminidase__InfluenzaA__AEW10796

SEQ ID NO: 173854 - RNA, 1410 nt, Artificial Sequence; identical to SEQ ID NO: 169248
  derived and/or modified sequence opt4 from neuraminidase__InfluenzaA__AEW10806

SEQ ID NO: 173855 - RNA, 1410 nt, Artificial Sequence; identical to SEQ ID NO: 169248
  derived and/or modified sequence opt4 from neuraminidase__InfluenzaA__AEW10816

SEQ ID NO: 173856 - RNA, 1410 nt, Artificial Sequence; identical to SEQ ID NO: 169258
  derived and/or modified sequence opt4 from neuraminidase__InfluenzaA__AEW10826

SEQ ID NO: 173857 - RNA, 1410 nt, Artificial Sequence; identical to SEQ ID NO: 169248
  derived and/or modified sequence opt4 from neuraminidase__InfluenzaA__AEW10836

SEQ ID NO: 173858 - RNA, 1410 nt, Artificial Sequence; identical to SEQ ID NO: 169248
  derived and/or modified sequence opt4 from neuraminidase__InfluenzaA__AEW10846

SEQ ID NO: 173859 - RNA, 1410 nt, Artificial Sequence; identical to SEQ ID NO: 169248
  derived and/or modified sequence opt4 from neuraminidase__InfluenzaA__AEW10856

SEQ ID NO: 173860 - RNA, 1410 nt, Artificial Sequence; identical to SEQ ID NO: 169248
  derived and/or modified sequence opt4 from neuraminidase__InfluenzaA__AEW10866

SEQ ID NO: 173861 - RNA, 1410 nt, Artificial Sequence; identical to SEQ ID NO: 169248
  derived and/or modified sequence opt4 from neuraminidase__InfluenzaA__AEW10876

SEQ ID NO: 173862 - RNA, 1410 nt, Artificial Sequence; identical to SEQ ID NO: 169248
  derived and/or modified sequence opt4 from neuraminidase__InfluenzaA__AEW10886

SEQ ID NO: 173863 - RNA, 1410 nt, Artificial Sequence; identical to SEQ ID NO: 169248
  derived and/or modified sequence opt4 from neuraminidase__InfluenzaA__AEW10896

SEQ ID NO: 173864 - RNA, 1410 nt, Artificial Sequence; identical to SEQ ID NO: 169248
  derived and/or modified sequence opt4 from neuraminidase__InfluenzaA__AEW10906

SEQ ID NO: 173865 - RNA, 1410 nt, Artificial Sequence; identical to SEQ ID NO: 169248
  derived and/or modified sequence opt4 from neuraminidase__InfluenzaA__AEW10916

SEQ ID NO: 173866 - RNA, 1410 nt, Artificial Sequence
  derived and/or modified sequence opt4 from neuraminidase__InfluenzaA__AEW10926
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucaucaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173867 - RNA, 1410 nt, Artificial Sequence; identical to SEQ ID NO: 169248
  derived and/or modified sequence opt4 from neuraminidase__InfluenzaA__AEW10936

SEQ ID NO: 173868 - RNA, 1410 nt, Artificial Sequence; identical to SEQ ID NO: 169248
  derived and/or modified sequence opt4 from neuraminidase__InfluenzaA__AEW10946

SEQ ID NO: 173869 - RNA, 1410 nt, Artificial Sequence; identical to SEQ ID NO: 169258
  derived and/or modified sequence opt4 from neuraminidase__InfluenzaA__AEW10956

SEQ ID NO: 173870 - RNA, 1410 nt, Artificial Sequence; identical to SEQ ID NO: 169258
  derived and/or modified sequence opt4 from neuraminidase__InfluenzaA__AEW10966

SEQ ID NO: 173871 - RNA, 1410 nt, Artificial Sequence; identical to SEQ ID NO: 169248
  derived and/or modified sequence opt4 from neuraminidase__InfluenzaA__AEW10976

SEQ ID NO: 173872 - RNA, 1410 nt, Artificial Sequence; identical to SEQ ID NO: 169258
  derived and/or modified sequence opt4 from neuraminidase__InfluenzaA__AEW10986

SEQ ID NO: 173873 - RNA, 1410 nt, Artificial Sequence; identical to SEQ ID NO: 169258
  derived and/or modified sequence opt4 from neuraminidase__InfluenzaA__AEW10996

SEQ ID NO: 173874 - RNA, 1410 nt, Artificial Sequence; identical to SEQ ID NO: 169258
  derived and/or modified sequence opt4 from neuraminidase__InfluenzaA__AEW11006

SEQ ID NO: 173875 - RNA, 1410 nt, Artificial Sequence; identical to SEQ ID NO: 169258
  derived and/or modified sequence opt4 from neuraminidase__InfluenzaA__AEW11016

SEQ ID NO: 173876 - RNA, 1410 nt, Artificial Sequence; identical to SEQ ID NO: 169258
  derived and/or modified sequence opt4 from neuraminidase__InfluenzaA__AEW11026

SEQ ID NO: 173877 - RNA, 1410 nt, Artificial Sequence; identical to SEQ ID NO: 169258
  derived and/or modified sequence opt4 from neuraminidase__InfluenzaA__AEW11036

SEQ ID NO: 173878 - RNA, 1410 nt, Artificial Sequence; identical to SEQ ID NO: 169248
  derived and/or modified sequence opt4 from neuraminidase__InfluenzaA__AEW11046

SEQ ID NO: 173879 - RNA, 1410 nt, Artificial Sequence; identical to SEQ ID NO: 169258
  derived and/or modified sequence opt4 from neuraminidase__InfluenzaA__AEW11056

SEQ ID NO: 173880 - RNA, 1410 nt, Artificial Sequence; identical to SEQ ID NO: 170062
  derived and/or modified sequence opt4 from neuraminidase__InfluenzaA__AEW11066

SEQ ID NO: 173881 - RNA, 1410 nt, Artificial Sequence; identical to SEQ ID NO: 170062
  derived and/or modified sequence opt4 from neuraminidase__InfluenzaA__AEW11076

SEQ ID NO: 173882 - RNA, 1410 nt, Artificial Sequence; identical to SEQ ID NO: 170062
  derived and/or modified sequence opt4 from neuraminidase__InfluenzaA__AEW11086

SEQ ID NO: 173883 - RNA, 1410 nt, Artificial Sequence; identical to SEQ ID NO: 170062
  derived and/or modified sequence opt4 from neuraminidase__InfluenzaA__AEW11096

SEQ ID NO: 173884 - RNA, 1410 nt, Artificial Sequence; identical to SEQ ID NO: 170062
  derived and/or modified sequence opt4 from neuraminidase__InfluenzaA__AEW11106

SEQ ID NO: 173885 - RNA, 1410 nt, Artificial Sequence; identical to SEQ ID NO: 169258
  derived and/or modified sequence opt4 from neuraminidase__InfluenzaA__AEW11116

SEQ ID NO: 173886 - RNA, 1410 nt, Artificial Sequence; identical to SEQ ID NO: 170062
  derived and/or modified sequence opt4 from neuraminidase__InfluenzaA__AEW11126

SEQ ID NO: 173887 - RNA, 1410 nt, Artificial Sequence; identical to SEQ ID NO: 169966
  derived and/or modified sequence opt4 from neuraminidase__InfluenzaA__AEW11136

SEQ ID NO: 173888 - RNA, 1410 nt, Artificial Sequence; identical to SEQ ID NO: 169258
  derived and/or modified sequence opt4 from neuraminidase__InfluenzaA__AEW11146

SEQ ID NO: 173889 - RNA, 1410 nt, Artificial Sequence; identical to SEQ ID NO: 169258
  derived and/or modified sequence opt4 from neuraminidase__InfluenzaA__AEW11156

SEQ ID NO: 173890 - RNA, 1410 nt, Artificial Sequence; identical to SEQ ID NO: 170062
  derived and/or modified sequence opt4 from neuraminidase__InfluenzaA__AEW11166

SEQ ID NO: 173891 - RNA, 1410 nt, Artificial Sequence; identical to SEQ ID NO: 170062
  derived and/or modified sequence opt4 from neuraminidase__InfluenzaA__AEW11176

SEQ ID NO: 173892 - RNA, 1410 nt, Artificial Sequence; identical to SEQ ID NO: 169258
  derived and/or modified sequence opt4 from neuraminidase__InfluenzaA__AEW11186

SEQ ID NO: 173893 - RNA, 1410 nt, Artificial Sequence; identical to SEQ ID NO: 170062
  derived and/or modified sequence opt4 from neuraminidase__InfluenzaA__AEW11196

SEQ ID NO: 173894 - RNA, 1410 nt, Artificial Sequence; identical to SEQ ID NO: 169258
  derived and/or modified sequence opt4 from neuraminidase__InfluenzaA__AEW11206

SEQ ID NO: 173895 - RNA, 1410 nt, Artificial Sequence; identical to SEQ ID NO: 169258
  derived and/or modified sequence opt4 from neuraminidase__InfluenzaA__AEW11216

SEQ ID NO: 173896 - RNA, 1410 nt, Artificial Sequence; identical to SEQ ID NO: 169966
  derived and/or modified sequence opt4 from neuraminidase__InfluenzaA__AEW11226

SEQ ID NO: 173897 - RNA, 1410 nt, Artificial Sequence; identical to SEQ ID NO: 169258
  derived and/or modified sequence opt4 from neuraminidase__InfluenzaA__AEW11236

SEQ ID NO: 173898 - RNA, 1410 nt, Artificial Sequence; identical to SEQ ID NO: 169258
  derived and/or modified sequence opt4 from neuraminidase__InfluenzaA__AEW11246

SEQ ID NO: 173899 - RNA, 1410 nt, Artificial Sequence; identical to SEQ ID NO: 170062
  derived and/or modified sequence opt4 from neuraminidase__InfluenzaA__AEW11255

SEQ ID NO: 173900 - RNA, 1410 nt, Artificial Sequence; identical to SEQ ID NO: 170062
  derived and/or modified sequence opt4 from neuraminidase__InfluenzaA__AEW11265

SEQ ID NO: 173901 - RNA, 1410 nt, Artificial Sequence; identical to SEQ ID NO: 169258
  derived and/or modified sequence opt4 from neuraminidase__InfluenzaA__AEW11275

SEQ ID NO: 173902 - RNA, 1410 nt, Artificial Sequence
  derived and/or modified sequence opt4 from neuraminidase__InfluenzaA__AEW11285
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagaaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173903 - RNA, 1410 nt, Artificial Sequence; identical to SEQ ID NO: 170062
  derived and/or modified sequence opt4 from neuraminidase__InfluenzaA__AEW11295

SEQ ID NO: 173904 - RNA, 1410 nt, Artificial Sequence; identical to SEQ ID NO: 169258
  derived and/or modified sequence opt4 from neuraminidase__InfluenzaA__AEW11305

SEQ ID NO: 173905 - RNA, 1410 nt, Artificial Sequence; identical to SEQ ID NO: 170062
  derived and/or modified sequence opt4 from neuraminidase__InfluenzaA__AEW11315

SEQ ID NO: 173906 - RNA, 1410 nt, Artificial Sequence; identical to SEQ ID NO: 169258
  derived and/or modified sequence opt4 from neuraminidase__InfluenzaA__AEW11325

SEQ ID NO: 173907 - RNA, 1410 nt, Artificial Sequence; identical to SEQ ID NO: 169258
  derived and/or modified sequence opt4 from neuraminidase__InfluenzaA__AEW25299

SEQ ID NO: 173908 - RNA, 1410 nt, Artificial Sequence; identical to SEQ ID NO: 169258
  derived and/or modified sequence opt4 from neuraminidase__InfluenzaA__AEW25308

SEQ ID NO: 173909 - RNA, 1410 nt, Artificial Sequence; identical to SEQ ID NO: 170331
  derived and/or modified sequence opt4 from neuraminidase__InfluenzaA__AEW25317

SEQ ID NO: 173910 - RNA, 1410 nt, Artificial Sequence; identical to SEQ ID NO: 169258
  derived and/or modified sequence opt4 from neuraminidase__InfluenzaA__AEW25324

SEQ ID NO: 173911 - RNA, 1410 nt, Artificial Sequence
  derived and/or modified sequence opt4 from neuraminidase__InfluenzaA__AEW25327
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccccccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacugcgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173912 - RNA, 1410 nt, Artificial Sequence
  derived and/or modified sequence opt4 from neuraminidase__InfluenzaA__AEW25333
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccacaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcgugugggugggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacacugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173913 - RNA, 1410 nt, Artificial Sequence
  derived and/or modified sequence opt4 from neuraminidase__InfluenzaA__AEW25338
augaaccccaaccagaagaucaucaccaucggcagcgugugcauggccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucagaagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173914 - RNA, 1410 nt, Artificial Sequence
  derived and/or modified sequence opt4 from neuraminidase__InfluenzaA__AEW25343
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagaagcgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgugugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacagccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173915 - RNA, 1410 nt, Artificial Sequence
  derived and/or modified sequence opt4 from neuraminidase__InfluenzaA__AEW25351
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccacaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaacgacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaccuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173916 - RNA, 1410 nt, Artificial Sequence
  derived and/or modified sequence opt4 from neuraminidase__InfluenzaA__AEW25358
augaaccccaaccagaagaucaucaccaucggcagcgugugcaugaccaucggcauggccaaccugauccugcagaucggcaacaucaucagcaucugggugagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaccagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgugaaguga

SEQ ID NO: 173917 - RNA, 1410 nt, Artificial Sequence; identical to SEQ ID NO: 169258
  derived and/or modified sequence opt4 from neuraminidase__InfluenzaA__AEW25361

SEQ ID NO: 173918 - RNA, 1410 nt, Artificial Sequence
  derived and/or modified sequence opt4 from neuraminidase__InfluenzaA__AEW25379
augaaccccaaccagaagaucaucaccaucggcagcgugugcaugaccaucggcauggccaaccugauccugcagaucggcaacaucaucagcaucuggaccagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgaggugaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcgacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173919 - RNA, 1410 nt, Artificial Sequence
  derived and/or modified sequence opt4 from neuraminidase__InfluenzaA__AEW25387
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcguggacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucgaggacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173920 - RNA, 1410 nt, Artificial Sequence
  derived and/or modified sequence opt4 from neuraminidase__InfluenzaA__AEW25392
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcacgacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173921 - RNA, 1410 nt, Artificial Sequence
  derived and/or modified sequence opt4 from neuraminidase__InfluenzaA__AEW25397
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagcccguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacagccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaacgugggcuggagcuggcccgacggcgccgagcugcccuucaccaucgacaaguga

SEQ ID NO: 173922 - RNA, 1410 nt, Artificial Sequence; identical to SEQ ID NO: 169258
  derived and/or modified sequence opt4 from neuraminidase__InfluenzaA__AEW25402

SEQ ID NO: 173923 - RNA, 1410 nt, Artificial Sequence; identical to SEQ ID NO: 169258
  derived and/or modified sequence opt4 from neuraminidase__InfluenzaA__AEW25407

SEQ ID NO: 173924 - RNA, 1410 nt, Artificial Sequence
  derived and/or modified sequence opt4 from neuraminidase__InfluenzaA__AEW25418
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccacaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucggcaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgagaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcugguucuggcccgacggcgccgagcugcccuucaccaucgacaaguga

SEQ ID NO: 173925 - RNA, 1410 nt, Artificial Sequence
  derived and/or modified sequence opt4 from neuraminidase__InfluenzaA__AEW25423
augaaccccaaccagaagaucaucaccaucggcagcgugugcaugaccaucggcauggccaaccugauccugcagaucggcaacaucaucagcaucuggaucagcaacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173926 - RNA, 1410 nt, Artificial Sequence; identical to SEQ ID NO: 169258
  derived and/or modified sequence opt4 from neuraminidase__InfluenzaA__AEW25426

SEQ ID NO: 173927 - RNA, 1410 nt, Artificial Sequence
  derived and/or modified sequence opt4 from neuraminidase__InfluenzaA__AEW25432
augaaccccaaccagaagaucaucaccaucggcagcgugugcaugaccaucggcauggccaaccugauccugcagaucggcaacaucaucagcaucuggaccagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacagcagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcaucaacagcgacgccgugggcuggagcuggcccgacggcgccgagcugcccuucaccaucgacaaguga

SEQ ID NO: 173928 - RNA, 1410 nt, Artificial Sequence
  derived and/or modified sequence opt4 from neuraminidase__InfluenzaA__AEW25436
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccaugggcuggagcuggcccgacggcgccgagcugcccuucaccaucgacaaguga

SEQ ID NO: 173929 - RNA, 1410 nt, Artificial Sequence; identical to SEQ ID NO: 169258
  derived and/or modified sequence opt4 from neuraminidase__InfluenzaA__AEW25440

SEQ ID NO: 173930 - RNA, 1410 nt, Artificial Sequence
  derived and/or modified sequence opt4 from neuraminidase__InfluenzaA__AEW25448
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaccgacaaguga

SEQ ID NO: 173931 - RNA, 1410 nt, Artificial Sequence; identical to SEQ ID NO: 169258
  derived and/or modified sequence opt4 from neuraminidase__InfluenzaA__AEW25456

SEQ ID NO: 173932 - RNA, 1410 nt, Artificial Sequence
  derived and/or modified sequence opt4 from neuraminidase__InfluenzaA__AEW25464
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagcugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173933 - RNA, 1410 nt, Artificial Sequence
  derived and/or modified sequence opt4 from neuraminidase__InfluenzaA__AEW25474
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccagcaccaucgacaaguga

SEQ ID NO: 173934 - RNA, 1410 nt, Artificial Sequence
  derived and/or modified sequence opt4 from neuraminidase__InfluenzaA__AEW25484
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccuggaucaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgaccacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173935 - RNA, 1410 nt, Artificial Sequence
  derived and/or modified sequence opt4 from neuraminidase__InfluenzaA__AEW25494
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacagcaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaccuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173936 - RNA, 1410 nt, Artificial Sequence
  derived and/or modified sequence opt4 from neuraminidase__InfluenzaA__AEW25503
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcgccuggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173937 - RNA, 1410 nt, Artificial Sequence
  derived and/or modified sequence opt4 from neuraminidase__InfluenzaA__AEW25511
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccacaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgugguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173938 - RNA, 1410 nt, Artificial Sequence
  derived and/or modified sequence opt4 from neuraminidase__InfluenzaA__AEW25530
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccacaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagauacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgagaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173939 - RNA, 1410 nt, Artificial Sequence
  derived and/or modified sequence opt4 from neuraminidase__InfluenzaA__AEW25537
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaaccaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173940 - RNA, 1410 nt, Artificial Sequence; identical to SEQ ID NO: 169258
  derived and/or modified sequence opt4 from neuraminidase__InfluenzaA__AEW25547

SEQ ID NO: 173941 - RNA, 1410 nt, Artificial Sequence; identical to SEQ ID NO: 169258
  derived and/or modified sequence opt4 from neuraminidase__InfluenzaA__AEW25556

SEQ ID NO: 173942 - RNA, 1410 nt, Artificial Sequence; identical to SEQ ID NO: 169258
  derived and/or modified sequence opt4 from neuraminidase__InfluenzaA__AEW25566

SEQ ID NO: 173943 - RNA, 1410 nt, Artificial Sequence
  derived and/or modified sequence opt4 from neuraminidase__InfluenzaA__AEW25584
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcagggcaucgugggcaucaacgaguggagcggcuacggcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173944 - RNA, 1410 nt, Artificial Sequence; identical to SEQ ID NO: 169258
  derived and/or modified sequence opt4 from neuraminidase__InfluenzaA__AEW25592

SEQ ID NO: 173945 - RNA, 1410 nt, Artificial Sequence
  derived and/or modified sequence opt4 from neuraminidase__InfluenzaA__AEW25602
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaagaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173946 - RNA, 1410 nt, Artificial Sequence
  derived and/or modified sequence opt4 from neuraminidase__InfluenzaA__AEW25612
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacagacaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173947 - RNA, 1410 nt, Artificial Sequence
  derived and/or modified sequence opt4 from neuraminidase__InfluenzaA__AEW25622
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacagcaucuggaccagcggcagcagcaucagcuucugcggcgugaacagcgacaccgugggcuggagcuggcccgacggcgccgagcugcccuucaccaucgacaaguga

SEQ ID NO: 173948 - RNA, 1410 nt, Artificial Sequence
  derived and/or modified sequence opt4 from neuraminidase__InfluenzaA__AEW25631
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccagcggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173949 - RNA, 1410 nt, Artificial Sequence; identical to SEQ ID NO: 169258
  derived and/or modified sequence opt4 from neuraminidase__InfluenzaA__AEW25639

SEQ ID NO: 173950 - RNA, 1410 nt, Artificial Sequence
  derived and/or modified sequence opt4 from neuraminidase__InfluenzaA__AEW25648
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccacaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173951 - RNA, 1410 nt, Artificial Sequence
  derived and/or modified sequence opt4 from neuraminidase__InfluenzaA__AEW25656
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuuccccaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173952 - RNA, 1410 nt, Artificial Sequence
  derived and/or modified sequence opt4 from neuraminidase__InfluenzaA__AEW25664
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucaccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccggcggcuggagcuggcccgacggcgccgagcugcccuucaccaucgacaaguga

SEQ ID NO: 173953 - RNA, 1410 nt, Artificial Sequence; identical to SEQ ID NO: 173947
  derived and/or modified sequence opt4 from neuraminidase__InfluenzaA__AEW25671

SEQ ID NO: 173954 - RNA, 1410 nt, Artificial Sequence; identical to SEQ ID NO: 170435
  derived and/or modified sequence opt4 from neuraminidase__InfluenzaA__AEW25680

SEQ ID NO: 173955 - RNA, 1410 nt, Artificial Sequence
  derived and/or modified sequence opt4 from neuraminidase__InfluenzaA__AEW25689
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagagugggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 173956 - RNA, 1410 nt, Artificial Sequence; identical to SEQ ID NO: 173950
  derived and/or modified sequence opt4 from neuraminidase__InfluenzaA__AEW25698

SEQ ID NO: 173957 - RNA, 1410 nt, Artificial Sequence; identical to SEQ ID NO: 169258
  derived and/or modified sequence opt4 from neuraminidase__InfluenzaA__AEW25708

SEQ ID NO: 173958 - RNA, 1410 nt, Artificial Sequence; identical to SEQ ID NO: 169258
  derived and/or modified sequence opt4 from neuraminidase__InfluenzaA__AEX09177

SEQ ID NO: 173959 - RNA, 1413 nt, Artificial Sequence
  derived and/or modified sequence opt4 from neuraminidase__InfluenzaA__AEX33324
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaccaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173960 - RNA, 1413 nt, Artificial Sequence
  derived and/or modified sequence opt4 from neuraminidase__InfluenzaA__AEX33368
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcgccaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173961 - RNA, 1413 nt, Artificial Sequence
  derived and/or modified sequence opt4 from neuraminidase__InfluenzaA__AEX33379
augaaccccaaccagaagaucaucaccaucggcagcaucagcaucgccaucggcaucaucagccugaugcugcagaucggcaacaucaucagcaucugggccagccacagcauccagaccggcauccagaaccacaccggcaucugcaaccagagaaucaucaccuacgagaacagcaccugggugaaccacaccuacgugaccaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccagagacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173962 - RNA, 1413 nt, Artificial Sequence; identical to SEQ ID NO: 173961
  derived and/or modified sequence opt4 from neuraminidase__InfluenzaA__AEX33390

SEQ ID NO: 173963 - RNA, 1413 nt, Artificial Sequence; identical to SEQ ID NO: 173961
  derived and/or modified sequence opt4 from neuraminidase__InfluenzaA__AEX33401

SEQ ID NO: 173964 - RNA, 1413 nt, Artificial Sequence; identical to SEQ ID NO: 173961
  derived and/or modified sequence opt4 from neuraminidase__InfluenzaA__AEX33412

SEQ ID NO: 173965 - RNA, 1413 nt, Artificial Sequence; identical to SEQ ID NO: 173961
  derived and/or modified sequence opt4 from neuraminidase__InfluenzaA__AEX33423

SEQ ID NO: 173966 - RNA, 1413 nt, Artificial Sequence; identical to SEQ ID NO: 173961
  derived and/or modified sequence opt4 from neuraminidase__InfluenzaA__AEX33434

SEQ ID NO: 173967 - RNA, 1413 nt, Artificial Sequence; identical to SEQ ID NO: 173961
  derived and/or modified sequence opt4 from neuraminidase__InfluenzaA__AEX33445

SEQ ID NO: 173968 - RNA, 1410 nt, Artificial Sequence
  derived and/or modified sequence opt4 from neuraminidase__InfluenzaA__AEX33544
augaaccccaaccagaagaucaucaccaucggcagcuucagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggagaagaccgaggugugguggaccagcaacagcaucgugguguucugcggcaccagcggcaccuacggcaccggcagcuggcccgacggcgccgacaucaaccugaugcccaucuga

SEQ ID NO: 173969 - RNA, 1410 nt, Artificial Sequence; identical to SEQ ID NO: 167234
  derived and/or modified sequence opt4 from neuraminidase__InfluenzaA__AEX33555

SEQ ID NO: 173970 - RNA, 1410 nt, Artificial Sequence
  derived and/or modified sequence opt4 from neuraminidase__InfluenzaA__AEX33610
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacaacaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173971 - RNA, 1410 nt, Artificial Sequence
  derived and/or modified sequence opt4 from neuraminidase__InfluenzaA__AEX33828
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173972 - RNA, 1410 nt, Artificial Sequence; identical to SEQ ID NO: 167232
  derived and/or modified sequence opt4 from neuraminidase__InfluenzaA__AEX33839

SEQ ID NO: 173973 - RNA, 1413 nt, Artificial Sequence
  derived and/or modified sequence opt4 from neuraminidase__InfluenzaA__AEX33861
augaaccccaaccagaagaucaucaccaucggcagcaucagcaucgccaucggcaccaucagccugaugcugcaggugggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcguggcccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggccaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 173974 - RNA, 1410 nt, Artificial Sequence
  derived and/or modified sequence opt4 from neuraminidase__InfluenzaA__AEX33872
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcagugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173975 - RNA, 1410 nt, Artificial Sequence; identical to SEQ ID NO: 167232
  derived and/or modified sequence opt4 from neuraminidase__InfluenzaA__AEX33883

SEQ ID NO: 173976 - RNA, 1410 nt, Artificial Sequence
  derived and/or modified sequence opt4 from neuraminidase__InfluenzaA__AEX33894
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucgacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173977 - RNA, 1413 nt, Artificial Sequence
  derived and/or modified sequence opt4 from neuraminidase__InfluenzaA__AEX33916
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaccggcuacaucugcagcggcguguucggcgacaaccccagacccaaggacggcgagggcagcugcaaccccaugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 173978 - RNA, 1413 nt, Artificial Sequence; identical to SEQ ID NO: 168389
  derived and/or modified sequence opt4 from neuraminidase__InfluenzaA__AEX33927

SEQ ID NO: 173979 - RNA, 1413 nt, Artificial Sequence
  derived and/or modified sequence opt4 from neuraminidase__InfluenzaA__AEX33938
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacguggugguggagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccaccaacuggagcuggcccgacggcgccgagcugcccuucaccaucgacaaguga

SEQ ID NO: 173980 - RNA, 1413 nt, Artificial Sequence
  derived and/or modified sequence opt4 from neuraminidase__InfluenzaA__AEX33949
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacguggugguggagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccgugaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 173981 - RNA, 1410 nt, Artificial Sequence
  derived and/or modified sequence opt4 from neuraminidase__InfluenzaA__AEX33971
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaccguguaccugaccaacaccaccaccgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggcaucgugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173982 - RNA, 1410 nt, Artificial Sequence
  derived and/or modified sequence opt4 from neuraminidase__InfluenzaA__AEX33993
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 173983 - RNA, 1410 nt, Artificial Sequence; identical to SEQ ID NO: 169032
  derived and/or modified sequence opt4 from neuraminidase__InfluenzaA__AEX34026

SEQ ID NO: 173984 - RNA, 1410 nt, Artificial Sequence
  derived and/or modified sequence opt4 from neuraminidase__InfluenzaA__AEX34036
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcgacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173985 - RNA, 1410 nt, Artificial Sequence
  derived and/or modified sequence opt4 from neuraminidase__InfluenzaA__AEX34058
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccugaccaacaccaccaucgagaaggagaucugccccaagcugaccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173986 - RNA, 1410 nt, Artificial Sequence
  derived and/or modified sequence opt4 from neuraminidase__InfluenzaA__AEX34103
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggaggugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcaacgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccaaggugcuguggaccagcaacagcaucgugguguucugcggcaccagcggcaccuacggcaccggcagcuggcccgacggcgccgacaucaaccugaugcccaucuga

SEQ ID NO: 173987 - RNA, 1410 nt, Artificial Sequence
  derived and/or modified sequence opt4 from neuraminidase__InfluenzaA__AEX34114
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccccaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173988 - RNA, 1410 nt, Artificial Sequence
  derived and/or modified sequence opt4 from neuraminidase__InfluenzaA__AEX34137
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173989 - RNA, 1410 nt, Artificial Sequence
  derived and/or modified sequence opt4 from neuraminidase__InfluenzaA__AEX34191
augaaccccaaccagaagaucaucaccaucggcagcgugagccugagcaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173990 - RNA, 1410 nt, Artificial Sequence
  derived and/or modified sequence opt4 from neuraminidase__InfluenzaA__AEX34224
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173991 - RNA, 1410 nt, Artificial Sequence
  derived and/or modified sequence opt4 from neuraminidase__InfluenzaA__AEX34235
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagagcgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173992 - RNA, 1410 nt, Artificial Sequence
  derived and/or modified sequence opt4 from neuraminidase__InfluenzaA__AEX34246
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcaggugaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173993 - RNA, 1410 nt, Artificial Sequence
  derived and/or modified sequence opt4 from neuraminidase__InfluenzaA__AEX34257
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173994 - RNA, 1410 nt, Artificial Sequence
  derived and/or modified sequence opt4 from neuraminidase__InfluenzaA__AEX34268
augaaccccaacaagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173995 - RNA, 1410 nt, Artificial Sequence
  derived and/or modified sequence opt4 from neuraminidase__InfluenzaA__AEX34278
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgagaagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 173996 - RNA, 1413 nt, Artificial Sequence
  derived and/or modified sequence opt4 from neuraminidase__InfluenzaA__AEX34310
augaaccccaaccagaagaucaucaccaucggcagcaucagcaucgccaucggcaucaucagccugaugcugcagaucggcaacaucaucagcaucugggccagccacagcauccagaccggcacccagaaccacaccggcaucugcaaccagagaaucaucaccuacgagaacagcaccugggugaaccacaccuacgugaacaucaacaacaccaacgugguggccggcaaggacaagacccccgugacccuggugggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaagggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccggcgagaacaccaccaucuggaccagcggcagcagcaucagcuucugcggcgugaacggcgacaucgccaacuggagcuggcccgacggcgccgagcugcccuucaccaucgacaaguga

SEQ ID NO: 173997 - RNA, 1413 nt, Artificial Sequence
  derived and/or modified sequence opt4 from neuraminidase__InfluenzaA__AEX34321
augaaccccaaccagaagaucaucaccaucggcagcaucagcaucgccaucggcaucaucagccugaugcugcagaucggcaacaucaucagcaucugggugagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 173998 - RNA, 1410 nt, Artificial Sequence; identical to SEQ ID NO: 168577
  derived and/or modified sequence opt4 from neuraminidase__InfluenzaA__AEX34356

SEQ ID NO: 173999 - RNA, 1410 nt, Artificial Sequence
  derived and/or modified sequence opt4 from neuraminidase__InfluenzaA__AEX34367
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgccaagcacguggaggagugcagcugcuaccccagacaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174000 - RNA, 1410 nt, Artificial Sequence
  derived and/or modified sequence opt4 from neuraminidase__InfluenzaA__AEX34378
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaaccuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgccaagcacguggaggagugcagcugcuaccccagacaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174001 - RNA, 1410 nt, Artificial Sequence
  derived and/or modified sequence opt4 from neuraminidase__InfluenzaA__AEX34400
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174002 - RNA, 1413 nt, Artificial Sequence
  derived and/or modified sequence opt4 from neuraminidase__InfluenzaA__AEX34432
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacguggugguggagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcaccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 174003 - RNA, 1413 nt, Artificial Sequence; identical to SEQ ID NO: 174002
  derived and/or modified sequence opt4 from neuraminidase__InfluenzaA__AEX34443

SEQ ID NO: 174004 - RNA, 1410 nt, Artificial Sequence; identical to SEQ ID NO: 169123
  derived and/or modified sequence opt4 from neuraminidase__InfluenzaA__AEX34454

SEQ ID NO: 174005 - RNA, 1413 nt, Artificial Sequence
  derived and/or modified sequence opt4 from neuraminidase__InfluenzaA__AEX34465
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcaucaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174006 - RNA, 1413 nt, Artificial Sequence; identical to SEQ ID NO: 173959
  derived and/or modified sequence opt4 from neuraminidase__InfluenzaA__AEX34476

SEQ ID NO: 174007 - RNA, 1413 nt, Artificial Sequence; identical to SEQ ID NO: 173961
  derived and/or modified sequence opt4 from neuraminidase__InfluenzaA__AEX34487

SEQ ID NO: 174008 - RNA, 1413 nt, Artificial Sequence; identical to SEQ ID NO: 173961
  derived and/or modified sequence opt4 from neuraminidase__InfluenzaA__AEX34498

SEQ ID NO: 174009 - RNA, 1413 nt, Artificial Sequence; identical to SEQ ID NO: 173961
  derived and/or modified sequence opt4 from neuraminidase__InfluenzaA__AEX34509

SEQ ID NO: 174010 - RNA, 1413 nt, Artificial Sequence; identical to SEQ ID NO: 173961
  derived and/or modified sequence opt4 from neuraminidase__InfluenzaA__AEX34520

SEQ ID NO: 174011 - RNA, 1413 nt, Artificial Sequence; identical to SEQ ID NO: 173961
  derived and/or modified sequence opt4 from neuraminidase__InfluenzaA__AEX34531

SEQ ID NO: 174012 - RNA, 1413 nt, Artificial Sequence; identical to SEQ ID NO: 173961
  derived and/or modified sequence opt4 from neuraminidase__InfluenzaA__AEX34542

SEQ ID NO: 174013 - RNA, 1413 nt, Artificial Sequence; identical to SEQ ID NO: 173961
  derived and/or modified sequence opt4 from neuraminidase__InfluenzaA__AEX34553

SEQ ID NO: 174014 - RNA, 1413 nt, Artificial Sequence; identical to SEQ ID NO: 173961
  derived and/or modified sequence opt4 from neuraminidase__InfluenzaA__AEX34564

SEQ ID NO: 174015 - RNA, 1413 nt, Artificial Sequence; identical to SEQ ID NO: 173961
  derived and/or modified sequence opt4 from neuraminidase__InfluenzaA__AEX34575

SEQ ID NO: 174016 - RNA, 1413 nt, Artificial Sequence; identical to SEQ ID NO: 173961
  derived and/or modified sequence opt4 from neuraminidase__InfluenzaA__AEX34586

SEQ ID NO: 174017 - RNA, 1413 nt, Artificial Sequence; identical to SEQ ID NO: 173961
  derived and/or modified sequence opt4 from neuraminidase__InfluenzaA__AEX34597

SEQ ID NO: 174018 - RNA, 1413 nt, Artificial Sequence; identical to SEQ ID NO: 173961
  derived and/or modified sequence opt4 from neuraminidase__InfluenzaA__AEX34608

SEQ ID NO: 174019 - RNA, 1413 nt, Artificial Sequence; identical to SEQ ID NO: 173961
  derived and/or modified sequence opt4 from neuraminidase__InfluenzaA__AEX34619

SEQ ID NO: 174020 - RNA, 1413 nt, Artificial Sequence; identical to SEQ ID NO: 173961
  derived and/or modified sequence opt4 from neuraminidase__InfluenzaA__AEX34630

SEQ ID NO: 174021 - RNA, 1413 nt, Artificial Sequence; identical to SEQ ID NO: 173961
  derived and/or modified sequence opt4 from neuraminidase__InfluenzaA__AEX34641

SEQ ID NO: 174022 - RNA, 1413 nt, Artificial Sequence
  derived and/or modified sequence opt4 from neuraminidase__InfluenzaA__AEX34653
augaaccccaaccagaagaucaucaccaucggcagcaucagcaucgccaucggcaucaucagccugaugcugcaggugggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcguggcccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggccaggugaccaagagcguggagcugaacgcccccaacuuccacuacgaggagugcagcugcuaccccgacaccggcaccgugaugugcgugugcagagacaacuggcacggcagcaacagacccugggugagcuucaaccaggaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 174023 - RNA, 1413 nt, Artificial Sequence
  derived and/or modified sequence opt4 from neuraminidase__InfluenzaA__AEX34664
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcagagagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccgccgacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 174024 - RNA, 1413 nt, Artificial Sequence; identical to SEQ ID NO: 174002
  derived and/or modified sequence opt4 from neuraminidase__InfluenzaA__AEX34686

SEQ ID NO: 174025 - RNA, 1413 nt, Artificial Sequence
  derived and/or modified sequence opt4 from neuraminidase__InfluenzaA__AEX34760
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacguggugguggagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgugaacuggagcuggcccgacggcgccgagcugcccuucaccaucgacaaguga

SEQ ID NO: 174026 - RNA, 1413 nt, Artificial Sequence
  derived and/or modified sequence opt4 from neuraminidase__InfluenzaA__AEX34771
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacguggugguggagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 174027 - RNA, 1413 nt, Artificial Sequence; identical to SEQ ID NO: 169981
  derived and/or modified sequence opt4 from neuraminidase__InfluenzaA__AEX34782

SEQ ID NO: 174028 - RNA, 1413 nt, Artificial Sequence
  derived and/or modified sequence opt4 from neuraminidase__InfluenzaA__AEX34793
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggugggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaagggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 174029 - RNA, 1413 nt, Artificial Sequence; identical to SEQ ID NO: 174028
  derived and/or modified sequence opt4 from neuraminidase__InfluenzaA__AEX34804

SEQ ID NO: 174030 - RNA, 1413 nt, Artificial Sequence
  derived and/or modified sequence opt4 from neuraminidase__InfluenzaA__AEX34815
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccugaccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174031 - RNA, 1413 nt, Artificial Sequence; identical to SEQ ID NO: 174028
  derived and/or modified sequence opt4 from neuraminidase__InfluenzaA__AEX34826

SEQ ID NO: 174032 - RNA, 1413 nt, Artificial Sequence; identical to SEQ ID NO: 174028
  derived and/or modified sequence opt4 from neuraminidase__InfluenzaA__AEX34837

SEQ ID NO: 174033 - RNA, 1413 nt, Artificial Sequence
  derived and/or modified sequence opt4 from neuraminidase__InfluenzaA__AEX34859
augaaccccaaccagaagaucaucaccaucggcagcaccagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccugaucggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaagggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 174034 - RNA, 1413 nt, Artificial Sequence
  derived and/or modified sequence opt4 from neuraminidase__InfluenzaA__AEX34870
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaucagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174035 - RNA, 1413 nt, Artificial Sequence
  derived and/or modified sequence opt4 from neuraminidase__InfluenzaA__AEX34881
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaaggcccccgugacccugaucggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaagggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 174036 - RNA, 1413 nt, Artificial Sequence
  derived and/or modified sequence opt4 from neuraminidase__InfluenzaA__AEX34892
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcagaacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174037 - RNA, 1413 nt, Artificial Sequence
  derived and/or modified sequence opt4 from neuraminidase__InfluenzaA__AEX34903
augaaccccaaccagaagaucaucaccaucggcagcaucagcaucgccaucggcaucaucagccugaugcugcagaucggcaacaucaucagcaucugggccagcagaagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggugggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaagggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugagacaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 174038 - RNA, 1413 nt, Artificial Sequence; identical to SEQ ID NO: 169981
  derived and/or modified sequence opt4 from neuraminidase__InfluenzaA__AEX34914

SEQ ID NO: 174039 - RNA, 1413 nt, Artificial Sequence; identical to SEQ ID NO: 169981
  derived and/or modified sequence opt4 from neuraminidase__InfluenzaA__AEX34925

SEQ ID NO: 174040 - RNA, 1413 nt, Artificial Sequence; identical to SEQ ID NO: 169981
  derived and/or modified sequence opt4 from neuraminidase__InfluenzaA__AEX34936

SEQ ID NO: 174041 - RNA, 1413 nt, Artificial Sequence; identical to SEQ ID NO: 169981
  derived and/or modified sequence opt4 from neuraminidase__InfluenzaA__AEX34947

SEQ ID NO: 174042 - RNA, 1413 nt, Artificial Sequence; identical to SEQ ID NO: 169981
  derived and/or modified sequence opt4 from neuraminidase__InfluenzaA__AEX34958

SEQ ID NO: 174043 - RNA, 1413 nt, Artificial Sequence; identical to SEQ ID NO: 169981
  derived and/or modified sequence opt4 from neuraminidase__InfluenzaA__AEX34969

SEQ ID NO: 174044 - RNA, 1413 nt, Artificial Sequence; identical to SEQ ID NO: 169981
  derived and/or modified sequence opt4 from neuraminidase__InfluenzaA__AEX34980

SEQ ID NO: 174045 - RNA, 1413 nt, Artificial Sequence; identical to SEQ ID NO: 169981
  derived and/or modified sequence opt4 from neuraminidase__InfluenzaA__AEX34991

SEQ ID NO: 174046 - RNA, 1413 nt, Artificial Sequence
  derived and/or modified sequence opt4 from neuraminidase__InfluenzaA__AEX35002
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccugaucggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaagggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacagagagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 174047 - RNA, 1413 nt, Artificial Sequence; identical to SEQ ID NO: 169981
  derived and/or modified sequence opt4 from neuraminidase__InfluenzaA__AEX35013

SEQ ID NO: 174048 - RNA, 1413 nt, Artificial Sequence; identical to SEQ ID NO: 169981
  derived and/or modified sequence opt4 from neuraminidase__InfluenzaA__AEX35024

SEQ ID NO: 174049 - RNA, 1413 nt, Artificial Sequence; identical to SEQ ID NO: 169981
  derived and/or modified sequence opt4 from neuraminidase__InfluenzaA__AEX35035

SEQ ID NO: 174050 - RNA, 1413 nt, Artificial Sequence; identical to SEQ ID NO: 169981
  derived and/or modified sequence opt4 from neuraminidase__InfluenzaA__AEX35046

SEQ ID NO: 174051 - RNA, 1413 nt, Artificial Sequence; identical to SEQ ID NO: 169981
  derived and/or modified sequence opt4 from neuraminidase__InfluenzaA__AEX35057

SEQ ID NO: 174052 - RNA, 1413 nt, Artificial Sequence; identical to SEQ ID NO: 169981
  derived and/or modified sequence opt4 from neuraminidase__InfluenzaA__AEX35068

SEQ ID NO: 174053 - RNA, 1413 nt, Artificial Sequence
  derived and/or modified sequence opt4 from neuraminidase__InfluenzaA__AEX35079
augaaccccaaccagaagaucaucaccaucggcagcaucagcaucgccaucggcaucaucagccugaugcugcagaucggcaacaucaucagcaugugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccaggaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174054 - RNA, 1413 nt, Artificial Sequence; identical to SEQ ID NO: 174028
  derived and/or modified sequence opt4 from neuraminidase__InfluenzaA__AEX35090

SEQ ID NO: 174055 - RNA, 1413 nt, Artificial Sequence
  derived and/or modified sequence opt4 from neuraminidase__InfluenzaA__AEX35101
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcguguucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174056 - RNA, 1413 nt, Artificial Sequence
  derived and/or modified sequence opt4 from neuraminidase__InfluenzaA__AEX35112
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgccagcaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174057 - RNA, 1413 nt, Artificial Sequence; identical to SEQ ID NO: 169981
  derived and/or modified sequence opt4 from neuraminidase__InfluenzaA__AEX35123

SEQ ID NO: 174058 - RNA, 1413 nt, Artificial Sequence
  derived and/or modified sequence opt4 from neuraminidase__InfluenzaA__AEX35145
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174059 - RNA, 1413 nt, Artificial Sequence; identical to SEQ ID NO: 174028
  derived and/or modified sequence opt4 from neuraminidase__InfluenzaA__AEX35156

SEQ ID NO: 174060 - RNA, 1413 nt, Artificial Sequence; identical to SEQ ID NO: 169981
  derived and/or modified sequence opt4 from neuraminidase__InfluenzaA__AEX35167

SEQ ID NO: 174061 - RNA, 1413 nt, Artificial Sequence
  derived and/or modified sequence opt4 from neuraminidase__InfluenzaA__AEX35178
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaaggagagaauccugagaacccaggagagcgagugcgugugcgugaacggcagcugcuucaccaucaugaccgacggccccagcaacggcgccgccagcuacaagaucuucaagaucgagaagggcaaggugaccaagagcagagagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccgccgacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 174062 - RNA, 1413 nt, Artificial Sequence; identical to SEQ ID NO: 174002
  derived and/or modified sequence opt4 from neuraminidase__InfluenzaA__AEX35189

SEQ ID NO: 174063 - RNA, 1413 nt, Artificial Sequence; identical to SEQ ID NO: 174002
  derived and/or modified sequence opt4 from neuraminidase__InfluenzaA__AEX35200

SEQ ID NO: 174064 - RNA, 1413 nt, Artificial Sequence; identical to SEQ ID NO: 169981
  derived and/or modified sequence opt4 from neuraminidase__InfluenzaA__AEX35211

SEQ ID NO: 174065 - RNA, 1410 nt, Artificial Sequence
  derived and/or modified sequence opt4 from neuraminidase__InfluenzaA__AEX35222
augaaccccaaccagaagaucaucaccaucggcagcgugagccugaccaucagcaccaucugcuucuucaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174066 - RNA, 1413 nt, Artificial Sequence; identical to SEQ ID NO: 173961
  derived and/or modified sequence opt4 from neuraminidase__InfluenzaA__AEX35233

SEQ ID NO: 174067 - RNA, 1410 nt, Artificial Sequence
  derived and/or modified sequence opt4 from neuraminidase__InfluenzaA__AEX35244
augaaccccaaccagaagaucaucaccaucggcagcgugagccugaccaucagcaccaucugcuucuucaugcagaucgccauccugaucaacaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggcaacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaacgaggugcuguggaccagcaacagcaucgugguguucugcggcaccagcggcaccuacggcaccggcagcuggcccgacggcgccgacaucaaccugaugcccguguga

SEQ ID NO: 174068 - RNA, 1410 nt, Artificial Sequence; identical to SEQ ID NO: 168449
  derived and/or modified sequence opt4 from neuraminidase__InfluenzaA__AEX35255

SEQ ID NO: 174069 - RNA, 1413 nt, Artificial Sequence; identical to SEQ ID NO: 173961
  derived and/or modified sequence opt4 from neuraminidase__InfluenzaA__AEX35266

SEQ ID NO: 174070 - RNA, 1413 nt, Artificial Sequence; identical to SEQ ID NO: 173961
  derived and/or modified sequence opt4 from neuraminidase__InfluenzaA__AEX35277

SEQ ID NO: 174071 - RNA, 1410 nt, Artificial Sequence
  derived and/or modified sequence opt4 from neuraminidase__InfluenzaA__AEX35288
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174072 - RNA, 1410 nt, Artificial Sequence; identical to SEQ ID NO: 167234
  derived and/or modified sequence opt4 from neuraminidase__InfluenzaA__AEX35299

SEQ ID NO: 174073 - RNA, 1410 nt, Artificial Sequence
  derived and/or modified sequence opt4 from neuraminidase__InfluenzaA__AEX35310
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcgacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 174074 - RNA, 1410 nt, Artificial Sequence; identical to SEQ ID NO: 167234
  derived and/or modified sequence opt4 from neuraminidase__InfluenzaA__AEX35321

SEQ ID NO: 174075 - RNA, 1410 nt, Artificial Sequence; identical to SEQ ID NO: 168449
  derived and/or modified sequence opt4 from neuraminidase__InfluenzaA__AEX35332

SEQ ID NO: 174076 - RNA, 1410 nt, Artificial Sequence; identical to SEQ ID NO: 168449
  derived and/or modified sequence opt4 from neuraminidase__InfluenzaA__AEX35343

SEQ ID NO: 174077 - RNA, 1410 nt, Artificial Sequence
  derived and/or modified sequence opt4 from neuraminidase__InfluenzaA__AEX35354
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcaccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174078 - RNA, 1410 nt, Artificial Sequence; identical to SEQ ID NO: 167234
  derived and/or modified sequence opt4 from neuraminidase__InfluenzaA__AEX35365

SEQ ID NO: 174079 - RNA, 1410 nt, Artificial Sequence
  derived and/or modified sequence opt4 from neuraminidase__InfluenzaA__AEX35376
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174080 - RNA, 1410 nt, Artificial Sequence; identical to SEQ ID NO: 167234
  derived and/or modified sequence opt4 from neuraminidase__InfluenzaA__AEX35387

SEQ ID NO: 174081 - RNA, 1410 nt, Artificial Sequence
  derived and/or modified sequence opt4 from neuraminidase__InfluenzaA__AEX35398
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174082 - RNA, 1410 nt, Artificial Sequence; identical to SEQ ID NO: 167234
  derived and/or modified sequence opt4 from neuraminidase__InfluenzaA__AEX35409

SEQ ID NO: 174083 - RNA, 1410 nt, Artificial Sequence; identical to SEQ ID NO: 174071
  derived and/or modified sequence opt4 from neuraminidase__InfluenzaA__AEX35420

SEQ ID NO: 174084 - RNA, 1410 nt, Artificial Sequence
  derived and/or modified sequence opt4 from neuraminidase__InfluenzaA__AEX35431
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagaaggagaccgaggugcuguggaccagcaacagcaucgugguguucugcggcaccagcggcaccuacggcaccggcagcuggcccgacggcgccgacaucaaccugaugcccaucuga

SEQ ID NO: 174085 - RNA, 1410 nt, Artificial Sequence; identical to SEQ ID NO: 167232
  derived and/or modified sequence opt4 from neuraminidase__InfluenzaA__AEX35453

SEQ ID NO: 174086 - RNA, 1410 nt, Artificial Sequence; identical to SEQ ID NO: 167232
  derived and/or modified sequence opt4 from neuraminidase__InfluenzaA__AEX35464

SEQ ID NO: 174087 - RNA, 1410 nt, Artificial Sequence; identical to SEQ ID NO: 167232
  derived and/or modified sequence opt4 from neuraminidase__InfluenzaA__AEX35475

SEQ ID NO: 174088 - RNA, 1410 nt, Artificial Sequence; identical to SEQ ID NO: 167232
  derived and/or modified sequence opt4 from neuraminidase__InfluenzaA__AEX35486

SEQ ID NO: 174089 - RNA, 1410 nt, Artificial Sequence
  derived and/or modified sequence opt4 from neuraminidase__InfluenzaA__AEX35497
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaagugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174090 - RNA, 1410 nt, Artificial Sequence; identical to SEQ ID NO: 167232
  derived and/or modified sequence opt4 from neuraminidase__InfluenzaA__AEX35508

SEQ ID NO: 174091 - RNA, 1410 nt, Artificial Sequence; identical to SEQ ID NO: 174089
  derived and/or modified sequence opt4 from neuraminidase__InfluenzaA__AEX35519

SEQ ID NO: 174092 - RNA, 1410 nt, Artificial Sequence
  derived and/or modified sequence opt4 from neuraminidase__InfluenzaA__AEX35530
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcagugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaccaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174093 - RNA, 1410 nt, Artificial Sequence; identical to SEQ ID NO: 167232
  derived and/or modified sequence opt4 from neuraminidase__InfluenzaA__AEX35541

SEQ ID NO: 174094 - RNA, 1410 nt, Artificial Sequence
  derived and/or modified sequence opt4 from neuraminidase__InfluenzaA__AEX35552
augaaccccaaccagaagaucaucaccaucggcagcgccagccugaccaucagcaccaucugcuucuucaugcagaucgccauccugaucaccaccgugacccugcacuucaagcaguacgaguucaaccccccccccaacaaccaggccaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgccagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174095 - RNA, 1410 nt, Artificial Sequence
  derived and/or modified sequence opt4 from neuraminidase__InfluenzaA__AEX35563
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174096 - RNA, 1410 nt, Artificial Sequence; identical to SEQ ID NO: 173976
  derived and/or modified sequence opt4 from neuraminidase__InfluenzaA__AEX35585

SEQ ID NO: 174097 - RNA, 1410 nt, Artificial Sequence
  derived and/or modified sequence opt4 from neuraminidase__InfluenzaA__AEX35596
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccgacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174098 - RNA, 1410 nt, Artificial Sequence; identical to SEQ ID NO: 167232
  derived and/or modified sequence opt4 from neuraminidase__InfluenzaA__AEX35607

SEQ ID NO: 174099 - RNA, 1410 nt, Artificial Sequence
  derived and/or modified sequence opt4 from neuraminidase__InfluenzaA__AEX35618
augaaccccaaccagaagaucaucaccaucggcagcgugagccugaccaucagcaccaucugcuucuucaugcagaucgccauccugaucaccaccgugacccugcacuucaagcaguacgagcugaacagcccccccaacaaccaggugaugcugugcgagcccaccaucaucgagagaaacaucaccgagaucguguaccugaccaacaccaccaucgagaaggagaccugccccaagcuggccgaguacagaaacuggagcaagccccagugcuacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagagacaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174100 - RNA, 1410 nt, Artificial Sequence
  derived and/or modified sequence opt4 from neuraminidase__InfluenzaA__AEX35640
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacaacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggagaggcagcaacagacccaucguggacaucaacaugaaggacuacagcaucgugagcagcuacgugugcagcggccuggugggcgacacccccagaaagaacgacagcagcagcagcggccacugccuggaccccaacgacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174101 - RNA, 1410 nt, Artificial Sequence
  derived and/or modified sequence opt4 from neuraminidase__InfluenzaA__AEX35651
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggaggacaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174102 - RNA, 1410 nt, Artificial Sequence; identical to SEQ ID NO: 168404
  derived and/or modified sequence opt4 from neuraminidase__InfluenzaA__AEX36105

SEQ ID NO: 174103 - RNA, 1410 nt, Artificial Sequence
  derived and/or modified sequence opt4 from neuraminidase__InfluenzaA__AEX36116
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174104 - RNA, 1410 nt, Artificial Sequence
  derived and/or modified sequence opt4 from neuraminidase__InfluenzaA__AEX36127
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggcugaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcgacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174105 - RNA, 1410 nt, Artificial Sequence
  derived and/or modified sequence opt4 from neuraminidase__InfluenzaA__AEX36149
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggaggacaagagcugcaucaacagaugcuucuacguggagcugaucagaggcagaaaggaggagaccgaggugcuguggaccaccaacagcaucgugguguucugcggcaccagcggcaccuacggcaccggcagcuggcccgacggcgccgacaucaaccugaugcccaucuga

SEQ ID NO: 174106 - RNA, 1410 nt, Artificial Sequence; identical to SEQ ID NO: 169032
  derived and/or modified sequence opt4 from neuraminidase__InfluenzaA__AEX36160

SEQ ID NO: 174107 - RNA, 1410 nt, Artificial Sequence
  derived and/or modified sequence opt4 from neuraminidase__InfluenzaA__AEX36171
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcgacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174108 - RNA, 1410 nt, Artificial Sequence
  derived and/or modified sequence opt4 from neuraminidase__InfluenzaA__AEX36193
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaugcugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174109 - RNA, 1410 nt, Artificial Sequence
  derived and/or modified sequence opt4 from neuraminidase__InfluenzaA__AEX36204
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174110 - RNA, 1410 nt, Artificial Sequence
  derived and/or modified sequence opt4 from neuraminidase__InfluenzaA__AEX36215
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagaagaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174111 - RNA, 1410 nt, Artificial Sequence
  derived and/or modified sequence opt4 from neuraminidase__InfluenzaA__AEX36226
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggcaucgugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174112 - RNA, 1410 nt, Artificial Sequence
  derived and/or modified sequence opt4 from neuraminidase__InfluenzaA__AEX36237
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggagaggcagcaacagacccaucguggacaucaacaugaaggacuacagcaucgugagcagcuacgugugcagcggccuggugggcgacacccccagaaagaacgacagcagcagcagcggccacugccuggaccccaacgacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174113 - RNA, 1410 nt, Artificial Sequence
  derived and/or modified sequence opt4 from neuraminidase__InfluenzaA__AEX36248
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcagagccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174114 - RNA, 1410 nt, Artificial Sequence; identical to SEQ ID NO: 169032
  derived and/or modified sequence opt4 from neuraminidase__InfluenzaA__AEX36259

SEQ ID NO: 174115 - RNA, 1410 nt, Artificial Sequence
  derived and/or modified sequence opt4 from neuraminidase__InfluenzaA__AEX36270
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagagaggaggagaccaaggugcuguggaccagcaacagcaucgugguguucugcggcaccagcggcaccuacggcaccggcagcuggcccgacggcgccgacaucaaccugaugcccaucuga

SEQ ID NO: 174116 - RNA, 1410 nt, Artificial Sequence
  derived and/or modified sequence opt4 from neuraminidase__InfluenzaA__AEX36281
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174117 - RNA, 1410 nt, Artificial Sequence; identical to SEQ ID NO: 174116
  derived and/or modified sequence opt4 from neuraminidase__InfluenzaA__AEX36292

SEQ ID NO: 174118 - RNA, 1410 nt, Artificial Sequence
  derived and/or modified sequence opt4 from neuraminidase__InfluenzaA__AEX36303
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174119 - RNA, 1410 nt, Artificial Sequence
  derived and/or modified sequence opt4 from neuraminidase__InfluenzaA__AEX36314
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcgaccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgagaucaaccugaugcccaucuga

SEQ ID NO: 174120 - RNA, 1410 nt, Artificial Sequence; identical to SEQ ID NO: 174116
  derived and/or modified sequence opt4 from neuraminidase__InfluenzaA__AEX36336

SEQ ID NO: 174121 - RNA, 1410 nt, Artificial Sequence
  derived and/or modified sequence opt4 from neuraminidase__InfluenzaA__AEX36347
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaucaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacgccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174122 - RNA, 1410 nt, Artificial Sequence; identical to SEQ ID NO: 168404
  derived and/or modified sequence opt4 from neuraminidase__InfluenzaA__AEX36358

SEQ ID NO: 174123 - RNA, 1410 nt, Artificial Sequence
  derived and/or modified sequence opt4 from neuraminidase__InfluenzaA__AEX36369
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaaccggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174124 - RNA, 1410 nt, Artificial Sequence
  derived and/or modified sequence opt4 from neuraminidase__InfluenzaA__AEX36391
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucgccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174125 - RNA, 1410 nt, Artificial Sequence
  derived and/or modified sequence opt4 from neuraminidase__InfluenzaA__AEX36402
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauuccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaaccggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174126 - RNA, 1410 nt, Artificial Sequence; identical to SEQ ID NO: 168404
  derived and/or modified sequence opt4 from neuraminidase__InfluenzaA__AEX36413

SEQ ID NO: 174127 - RNA, 1410 nt, Artificial Sequence
  derived and/or modified sequence opt4 from neuraminidase__InfluenzaA__AEX36424
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugcagcaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccaucagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174128 - RNA, 1410 nt, Artificial Sequence
  derived and/or modified sequence opt4 from neuraminidase__InfluenzaA__AEX36435
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaacagcaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174129 - RNA, 1410 nt, Artificial Sequence; identical to SEQ ID NO: 168586
  derived and/or modified sequence opt4 from neuraminidase__InfluenzaA__AEX36446

SEQ ID NO: 174130 - RNA, 1410 nt, Artificial Sequence; identical to SEQ ID NO: 168586
  derived and/or modified sequence opt4 from neuraminidase__InfluenzaA__AEX36457

SEQ ID NO: 174131 - RNA, 1410 nt, Artificial Sequence
  derived and/or modified sequence opt4 from neuraminidase__InfluenzaA__AEX36468
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcaacgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccaaggugcuguggaccagcaacagcaucgugguguucugcggcaccagcggcaccuacggcaccggcagcuggcccgacggcgccgacaucaaccugaugcccaucuga

SEQ ID NO: 174132 - RNA, 1410 nt, Artificial Sequence
  derived and/or modified sequence opt4 from neuraminidase__InfluenzaA__AEX36479
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccccaccaacaccaccaccgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174133 - RNA, 1410 nt, Artificial Sequence
  derived and/or modified sequence opt4 from neuraminidase__InfluenzaA__AEX36490
augaaccccaaccagaagaucaucaccaucggcagcgugagccugaccaucagcaccaucugcuucuucaugcagaucgccauccugaucaccaccgugacccugcacuucaagcaguacgaguucagcuacccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcaacgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccaaggugcuguggaccagcaacagcaucgugguguucugcggcaccagcggcaccuacggcaccggcagcuggcccgacggcgccgacaucaaccugaugcccaucuga

SEQ ID NO: 174134 - RNA, 1410 nt, Artificial Sequence
  derived and/or modified sequence opt4 from neuraminidase__InfluenzaA__AEX36501
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccugaccaacaccaccaucgagaaggagaagugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagagcgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174135 - RNA, 1410 nt, Artificial Sequence
  derived and/or modified sequence opt4 from neuraminidase__InfluenzaA__AEX36512
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174136 - RNA, 1410 nt, Artificial Sequence
  derived and/or modified sequence opt4 from neuraminidase__InfluenzaA__AEX36523
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174137 - RNA, 1410 nt, Artificial Sequence; identical to SEQ ID NO: 169119
  derived and/or modified sequence opt4 from neuraminidase__InfluenzaA__AEX36534

SEQ ID NO: 174138 - RNA, 1410 nt, Artificial Sequence
  derived and/or modified sequence opt4 from neuraminidase__InfluenzaA__AEX36545
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgcccugggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174139 - RNA, 1410 nt, Artificial Sequence; identical to SEQ ID NO: 169032
  derived and/or modified sequence opt4 from neuraminidase__InfluenzaA__AEX36556

SEQ ID NO: 174140 - RNA, 1410 nt, Artificial Sequence; identical to SEQ ID NO: 169032
  derived and/or modified sequence opt4 from neuraminidase__InfluenzaA__AEX36567

SEQ ID NO: 174141 - RNA, 1410 nt, Artificial Sequence
  derived and/or modified sequence opt4 from neuraminidase__InfluenzaA__AEX36578
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174142 - RNA, 1410 nt, Artificial Sequence; identical to SEQ ID NO: 174141
  derived and/or modified sequence opt4 from neuraminidase__InfluenzaA__AEX36589

SEQ ID NO: 174143 - RNA, 1410 nt, Artificial Sequence
  derived and/or modified sequence opt4 from neuraminidase__InfluenzaA__AEX36600
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacaacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174144 - RNA, 1410 nt, Artificial Sequence; identical to SEQ ID NO: 167234
  derived and/or modified sequence opt4 from neuraminidase__InfluenzaA__AEX36622

SEQ ID NO: 174145 - RNA, 1410 nt, Artificial Sequence
  derived and/or modified sequence opt4 from neuraminidase__InfluenzaA__AEX63619
augaaccccaaccagaagaucaucaccaucggcagcaucugcaugaccaucggcaucgccagccugauccugcagaucggcaacaucaucagcaucuggaucagccacagcauccagaccgagaaccagaaccagcccgagaucugcaaccagaacgugaucaccuacgagaacaacaccugggugaaccagaccuacgugaacgugagcaacaccaacuucguggccgagcaggccguggccagcgugaagcuggccggcaacagcagccugugccccgugagcggcugggccaucuacagcaaggacaacagcgugagaaucggcagcaagggcgacguguucgugaucagagagcccuucaucagcugcagccacagcgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaagaacauccugagaacccaggagagcgagugcgccugcgugaacggcagcugcuucaccgugaugaccgacggccccagcaacggccaggccagcuacaagguguucaagaucgagagaggcaagguggugaagagcguggagcugaacgcccccaacuaccacuacgaggagugcagcugcuaccccgagagcagcgagaucaccugcgugugcagagacaacuggcacggcagcaacagacccugggugagcuucaaccagaaccuggaguaccagaugggcuacaucugcagcggcaucuucggcgacaaccccagacccaacgacaagaccggcagcugcggccccguguucagcaacggcgccaacggcgugaagggcuucagcuucaaguacggcaacggcguguggaucggcagaaccaagagcaccagcagcagaaugggcuucgagaugaucugggaccccgacggcuggaccaagaccgacgacaaguucagcgugaagcaggacaucaucggcaucaccgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174146 - RNA, 1365 nt, Artificial Sequence; identical to SEQ ID NO: 168239
  derived and/or modified sequence opt4 from neuraminidase__InfluenzaA__AEX92876

SEQ ID NO: 174147 - RNA, 1365 nt, Artificial Sequence; identical to SEQ ID NO: 168239
  derived and/or modified sequence opt4 from neuraminidase__InfluenzaA__AEX92887

SEQ ID NO: 174148 - RNA, 1365 nt, Artificial Sequence; identical to SEQ ID NO: 168239
  derived and/or modified sequence opt4 from neuraminidase__InfluenzaA__AEX92904

SEQ ID NO: 174149 - RNA, 1365 nt, Artificial Sequence; identical to SEQ ID NO: 168239
  derived and/or modified sequence opt4 from neuraminidase__InfluenzaA__AEX96924

SEQ ID NO: 174150 - RNA, 1410 nt, Artificial Sequence; identical to SEQ ID NO: 170989
  derived and/or modified sequence opt4 from neuraminidase__InfluenzaA__AEY69091

SEQ ID NO: 174151 - RNA, 1410 nt, Artificial Sequence; identical to SEQ ID NO: 169119
  derived and/or modified sequence opt4 from neuraminidase__InfluenzaA__AEY69101

SEQ ID NO: 174152 - RNA, 1410 nt, Artificial Sequence; identical to SEQ ID NO: 169119
  derived and/or modified sequence opt4 from neuraminidase__InfluenzaA__AEY69112

SEQ ID NO: 174153 - RNA, 1410 nt, Artificial Sequence
  derived and/or modified sequence opt4 from neuraminidase__InfluenzaA__AEY69145
augaacaccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccaccaucaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcguggugguguucugcggcaccagcggcaccuacggcaccggcagcuggcccgacggcgccgacaucaaccugaugcccaucuga

SEQ ID NO: 174154 - RNA, 1410 nt, Artificial Sequence; identical to SEQ ID NO: 169119
  derived and/or modified sequence opt4 from neuraminidase__InfluenzaA__AEY69156

SEQ ID NO: 174155 - RNA, 1410 nt, Artificial Sequence
  derived and/or modified sequence opt4 from neuraminidase__InfluenzaA__AEY69167
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174156 - RNA, 1410 nt, Artificial Sequence; identical to SEQ ID NO: 174155
  derived and/or modified sequence opt4 from neuraminidase__InfluenzaA__AEY69178

SEQ ID NO: 174157 - RNA, 1410 nt, Artificial Sequence; identical to SEQ ID NO: 174155
  derived and/or modified sequence opt4 from neuraminidase__InfluenzaA__AEY69189

SEQ ID NO: 174158 - RNA, 1410 nt, Artificial Sequence
  derived and/or modified sequence opt4 from neuraminidase__InfluenzaA__AEY69211
augaaccccaaccagaagaucaucaccaucggcagcgugagccugaccaucagcaccaucugcuucuucaugcagaucgccauccugaucaccaccgugacccugcacuucaagcaguacaaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174159 - RNA, 1410 nt, Artificial Sequence; identical to SEQ ID NO: 174155
  derived and/or modified sequence opt4 from neuraminidase__InfluenzaA__AEY69233

SEQ ID NO: 174160 - RNA, 1410 nt, Artificial Sequence; identical to SEQ ID NO: 174155
  derived and/or modified sequence opt4 from neuraminidase__InfluenzaA__AEY69272

SEQ ID NO: 174161 - RNA, 1410 nt, Artificial Sequence; identical to SEQ ID NO: 174155
  derived and/or modified sequence opt4 from neuraminidase__InfluenzaA__AEY69283

SEQ ID NO: 174162 - RNA, 1410 nt, Artificial Sequence
  derived and/or modified sequence opt4 from neuraminidase__InfluenzaA__AEY69294
augaaccccaaccagaagaucaucaccaucggcagcgugagccugaccaucagcaccaucugcuucuucaugcagaccgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggcaacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174163 - RNA, 1410 nt, Artificial Sequence; identical to SEQ ID NO: 174162
  derived and/or modified sequence opt4 from neuraminidase__InfluenzaA__AEY69305

SEQ ID NO: 174164 - RNA, 1410 nt, Artificial Sequence; identical to SEQ ID NO: 174162
  derived and/or modified sequence opt4 from neuraminidase__InfluenzaA__AEY69316

SEQ ID NO: 174165 - RNA, 1410 nt, Artificial Sequence; identical to SEQ ID NO: 174162
  derived and/or modified sequence opt4 from neuraminidase__InfluenzaA__AEY69788

SEQ ID NO: 174166 - RNA, 1410 nt, Artificial Sequence; identical to SEQ ID NO: 169119
  derived and/or modified sequence opt4 from neuraminidase__InfluenzaA__AEY69799

SEQ ID NO: 174167 - RNA, 1410 nt, Artificial Sequence; identical to SEQ ID NO: 169119
  derived and/or modified sequence opt4 from neuraminidase__InfluenzaA__AEY69810

SEQ ID NO: 174168 - RNA, 1410 nt, Artificial Sequence; identical to SEQ ID NO: 174155
  derived and/or modified sequence opt4 from neuraminidase__InfluenzaA__AEY69832

SEQ ID NO: 174169 - RNA, 1410 nt, Artificial Sequence
  derived and/or modified sequence opt4 from neuraminidase__InfluenzaA__AEY69843
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucgccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174170 - RNA, 1410 nt, Artificial Sequence; identical to SEQ ID NO: 174155
  derived and/or modified sequence opt4 from neuraminidase__InfluenzaA__AEY69854

SEQ ID NO: 174171 - RNA, 1410 nt, Artificial Sequence; identical to SEQ ID NO: 174155
  derived and/or modified sequence opt4 from neuraminidase__InfluenzaA__AEY69876

SEQ ID NO: 174172 - RNA, 1410 nt, Artificial Sequence; identical to SEQ ID NO: 174155
  derived and/or modified sequence opt4 from neuraminidase__InfluenzaA__AEY69887

SEQ ID NO: 174173 - RNA, 1410 nt, Artificial Sequence; identical to SEQ ID NO: 174155
  derived and/or modified sequence opt4 from neuraminidase__InfluenzaA__AEY69898

SEQ ID NO: 174174 - RNA, 1410 nt, Artificial Sequence; identical to SEQ ID NO: 169119
  derived and/or modified sequence opt4 from neuraminidase__InfluenzaA__AEY69909

SEQ ID NO: 174175 - RNA, 1410 nt, Artificial Sequence
  derived and/or modified sequence opt4 from neuraminidase__InfluenzaA__AEY69942
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgacggcggcgacaucugggugaccagagagcccuacgugagcugcgaccccgacaagugcuaccaguucgcccugggccagggcaccacccugaacaacauccacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174176 - RNA, 1410 nt, Artificial Sequence; identical to SEQ ID NO: 174175
  derived and/or modified sequence opt4 from neuraminidase__InfluenzaA__AEY69953

SEQ ID NO: 174177 - RNA, 1410 nt, Artificial Sequence; identical to SEQ ID NO: 174175
  derived and/or modified sequence opt4 from neuraminidase__InfluenzaA__AEY69964

SEQ ID NO: 174178 - RNA, 1410 nt, Artificial Sequence; identical to SEQ ID NO: 174155
  derived and/or modified sequence opt4 from neuraminidase__InfluenzaA__AEY69975

SEQ ID NO: 174179 - RNA, 1410 nt, Artificial Sequence; identical to SEQ ID NO: 174155
  derived and/or modified sequence opt4 from neuraminidase__InfluenzaA__AEY69986

SEQ ID NO: 174180 - RNA, 1410 nt, Artificial Sequence; identical to SEQ ID NO: 174155
  derived and/or modified sequence opt4 from neuraminidase__InfluenzaA__AEY69997

SEQ ID NO: 174181 - RNA, 1410 nt, Artificial Sequence; identical to SEQ ID NO: 174155
  derived and/or modified sequence opt4 from neuraminidase__InfluenzaA__AEY70008

SEQ ID NO: 174182 - RNA, 1410 nt, Artificial Sequence; identical to SEQ ID NO: 174155
  derived and/or modified sequence opt4 from neuraminidase__InfluenzaA__AEY70019

SEQ ID NO: 174183 - RNA, 1410 nt, Artificial Sequence; identical to SEQ ID NO: 174155
  derived and/or modified sequence opt4 from neuraminidase__InfluenzaA__AEY70259

SEQ ID NO: 174184 - RNA, 1410 nt, Artificial Sequence; identical to SEQ ID NO: 174155
  derived and/or modified sequence opt4 from neuraminidase__InfluenzaA__AEY70270

SEQ ID NO: 174185 - RNA, 1410 nt, Artificial Sequence; identical to SEQ ID NO: 174155
  derived and/or modified sequence opt4 from neuraminidase__InfluenzaA__AEY70281

SEQ ID NO: 174186 - RNA, 1410 nt, Artificial Sequence; identical to SEQ ID NO: 169119
  derived and/or modified sequence opt4 from neuraminidase__InfluenzaA__AEY70303

SEQ ID NO: 174187 - RNA, 1410 nt, Artificial Sequence; identical to SEQ ID NO: 169119
  derived and/or modified sequence opt4 from neuraminidase__InfluenzaA__AEY70314

SEQ ID NO: 174188 - RNA, 1410 nt, Artificial Sequence
  derived and/or modified sequence opt4 from neuraminidase__InfluenzaA__AEY70325
augaaccccaaccagaagaucaucaccaucggcagcgugagccugaccaucagcaccaucugcuucuucaugcagaucgccauccugaugaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174189 - RNA, 1410 nt, Artificial Sequence
  derived and/or modified sequence opt4 from neuraminidase__InfluenzaA__AEY70336
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcaucugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggaggacaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174190 - RNA, 1410 nt, Artificial Sequence; identical to SEQ ID NO: 169258
  derived and/or modified sequence opt4 from neuraminidase__InfluenzaA__AEY70358

SEQ ID NO: 174191 - RNA, 1410 nt, Artificial Sequence; identical to SEQ ID NO: 169119
  derived and/or modified sequence opt4 from neuraminidase__InfluenzaA__AEY70379

SEQ ID NO: 174192 - RNA, 1410 nt, Artificial Sequence; identical to SEQ ID NO: 170881
  derived and/or modified sequence opt4 from neuraminidase__InfluenzaA__AFB70139

SEQ ID NO: 174193 - RNA, 1410 nt, Artificial Sequence; identical to SEQ ID NO: 169258
  derived and/or modified sequence opt4 from neuraminidase__InfluenzaA__AFB70141

SEQ ID NO: 174194 - RNA, 1410 nt, Artificial Sequence; identical to SEQ ID NO: 170881
  derived and/or modified sequence opt4 from neuraminidase__InfluenzaA__AFB70147

SEQ ID NO: 174195 - RNA, 1410 nt, Artificial Sequence; identical to SEQ ID NO: 169258
  derived and/or modified sequence opt4 from neuraminidase__InfluenzaA__AFB70153

SEQ ID NO: 174196 - RNA, 1410 nt, Artificial Sequence; identical to SEQ ID NO: 169258
  derived and/or modified sequence opt4 from neuraminidase__InfluenzaA__AFB70155

SEQ ID NO: 174197 - RNA, 1410 nt, Artificial Sequence; identical to SEQ ID NO: 170228
  derived and/or modified sequence opt4 from neuraminidase__InfluenzaA__AFB70157

SEQ ID NO: 174198 - RNA, 1410 nt, Artificial Sequence; identical to SEQ ID NO: 169258
  derived and/or modified sequence opt4 from neuraminidase__InfluenzaA__AFB70159

SEQ ID NO: 174199 - RNA, 1410 nt, Artificial Sequence
  derived and/or modified sequence opt4 from neuraminidase__InfluenzaA__AFB70161
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaccaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcugguacuggcccgacggcgccgagcugcccuucaccaucgacaaguga

SEQ ID NO: 174200 - RNA, 1410 nt, Artificial Sequence
  derived and/or modified sequence opt4 from neuraminidase__InfluenzaA__AFB70163
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacgccaucuggaccagcggcagcagcaucagcuucugcggcgugaacagcgacaccgugggcuggagcuggcccgacggcgccgagcugcccuucaccaucgacaaguga

SEQ ID NO: 174201 - RNA, 1410 nt, Artificial Sequence
  derived and/or modified sequence opt4 from neuraminidase__InfluenzaA__AFB70169
augaaccccaaccagaagaucaucaccaucggcagcgugugcaugaccaucggcauggccaaccugauccugcagaucggcaacaucaucagcaucuggaucaaccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174202 - RNA, 1410 nt, Artificial Sequence; identical to SEQ ID NO: 169258
  derived and/or modified sequence opt4 from neuraminidase__InfluenzaA__AFB70199

SEQ ID NO: 174203 - RNA, 1410 nt, Artificial Sequence; identical to SEQ ID NO: 169258
  derived and/or modified sequence opt4 from neuraminidase__InfluenzaA__AFB70209

SEQ ID NO: 174204 - RNA, 1410 nt, Artificial Sequence; identical to SEQ ID NO: 169258
  derived and/or modified sequence opt4 from neuraminidase__InfluenzaA__AFB70219

SEQ ID NO: 174205 - RNA, 1410 nt, Artificial Sequence; identical to SEQ ID NO: 169258
  derived and/or modified sequence opt4 from neuraminidase__InfluenzaA__AFB70229

SEQ ID NO: 174206 - RNA, 1410 nt, Artificial Sequence; identical to SEQ ID NO: 169258
  derived and/or modified sequence opt4 from neuraminidase__InfluenzaA__AFB70239

SEQ ID NO: 174207 - RNA, 1410 nt, Artificial Sequence; identical to SEQ ID NO: 169258
  derived and/or modified sequence opt4 from neuraminidase__InfluenzaA__AFB70249

SEQ ID NO: 174208 - RNA, 1410 nt, Artificial Sequence; identical to SEQ ID NO: 169258
  derived and/or modified sequence opt4 from neuraminidase__InfluenzaA__AFB70259

SEQ ID NO: 174209 - RNA, 1410 nt, Artificial Sequence; identical to SEQ ID NO: 170228
  derived and/or modified sequence opt4 from neuraminidase__InfluenzaA__AFB70269

SEQ ID NO: 174210 - RNA, 1410 nt, Artificial Sequence; identical to SEQ ID NO: 169258
  derived and/or modified sequence opt4 from neuraminidase__InfluenzaA__AFB70279

SEQ ID NO: 174211 - RNA, 1410 nt, Artificial Sequence; identical to SEQ ID NO: 169258
  derived and/or modified sequence opt4 from neuraminidase__InfluenzaA__AFB70289

SEQ ID NO: 174212 - RNA, 1410 nt, Artificial Sequence; identical to SEQ ID NO: 169258
  derived and/or modified sequence opt4 from neuraminidase__InfluenzaA__AFB70299

SEQ ID NO: 174213 - RNA, 1410 nt, Artificial Sequence; identical to SEQ ID NO: 169258
  derived and/or modified sequence opt4 from neuraminidase__InfluenzaA__AFB70309

SEQ ID NO: 174214 - RNA, 1410 nt, Artificial Sequence; identical to SEQ ID NO: 170881
  derived and/or modified sequence opt4 from neuraminidase__InfluenzaA__AFB70319

SEQ ID NO: 174215 - RNA, 1410 nt, Artificial Sequence; identical to SEQ ID NO: 169258
  derived and/or modified sequence opt4 from neuraminidase__InfluenzaA__AFB70329

SEQ ID NO: 174216 - RNA, 1410 nt, Artificial Sequence; identical to SEQ ID NO: 169258
  derived and/or modified sequence opt4 from neuraminidase__InfluenzaA__AFB70349

SEQ ID NO: 174217 - RNA, 1410 nt, Artificial Sequence; identical to SEQ ID NO: 169258
  derived and/or modified sequence opt4 from neuraminidase__InfluenzaA__AFB70359

SEQ ID NO: 174218 - RNA, 1410 nt, Artificial Sequence; identical to SEQ ID NO: 169258
  derived and/or modified sequence opt4 from neuraminidase__InfluenzaA__AFB70369

SEQ ID NO: 174219 - RNA, 1410 nt, Artificial Sequence; identical to SEQ ID NO: 169258
  derived and/or modified sequence opt4 from neuraminidase__InfluenzaA__AFB70379

SEQ ID NO: 174220 - RNA, 1410 nt, Artificial Sequence; identical to SEQ ID NO: 169258
  derived and/or modified sequence opt4 from neuraminidase__InfluenzaA__AFB70389

SEQ ID NO: 174221 - RNA, 1410 nt, Artificial Sequence; identical to SEQ ID NO: 169258
  derived and/or modified sequence opt4 from neuraminidase__InfluenzaA__AFB70399

SEQ ID NO: 174222 - RNA, 1410 nt, Artificial Sequence; identical to SEQ ID NO: 169258
  derived and/or modified sequence opt4 from neuraminidase__InfluenzaA__AFB70409

SEQ ID NO: 174223 - RNA, 1410 nt, Artificial Sequence
  derived and/or modified sequence opt4 from neuraminidase__InfluenzaA__AFB77614
augcaccccaaccaggaggugaucagcaucgugagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcugguucuggcccgacggcgccgagcugcccuucaccaucgacaaguga

SEQ ID NO: 174224 - RNA, 1410 nt, Artificial Sequence
  derived and/or modified sequence opt4 from neuraminidase__InfluenzaA__AFB77615
augcaccccaaccaggagaucaucaccuucgugagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174225 - RNA, 1410 nt, Artificial Sequence
  derived and/or modified sequence opt4 from neuraminidase__InfluenzaA__AFB78128
augaaccccaaccagaagaucaucaccaucggcagcgugagccugaccaucgccaccaucugcuuccugaugcagaucgugauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggagagaggcaacaugagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174226 - RNA, 1410 nt, Artificial Sequence
  derived and/or modified sequence opt4 from neuraminidase__InfluenzaA__AFC62078
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcuguucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacgacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174227 - RNA, 1410 nt, Artificial Sequence
  derived and/or modified sequence opt4 from neuraminidase__InfluenzaA__AFC62079
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcauccugggcgacaaccccagacccaacgacaagaccggcagcugcggccccgugagcagcaacggcgccaacggcgugaagggcuucagcuucaaguacggcaacggcgugugggugggcagaaccaagagcaucagcagcagaaacggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 174228 - RNA, 1410 nt, Artificial Sequence
  derived and/or modified sequence opt4 from neuraminidase__InfluenzaA__AFC62080
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggcaugggcugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174229 - RNA, 1410 nt, Artificial Sequence
  derived and/or modified sequence opt4 from neuraminidase__InfluenzaA__AFC62082
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagcaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174230 - RNA, 1410 nt, Artificial Sequence; identical to SEQ ID NO: 166745
  derived and/or modified sequence opt4 from neuraminidase__InfluenzaA__AFD63529

SEQ ID NO: 174231 - RNA, 1410 nt, Artificial Sequence; identical to SEQ ID NO: 166745
  derived and/or modified sequence opt4 from neuraminidase__InfluenzaA__AFD63540

SEQ ID NO: 174232 - RNA, 1410 nt, Artificial Sequence
  derived and/or modified sequence opt4 from neuraminidase__InfluenzaA__AFD63551
augaaccccaaccagaagaucaucaccaucggcagcgugagccugaccaucgccgccaucugcuuccugaugcagaucgccauccuggugaccaccgugacccugcacuucaagcagcacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacggcagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174233 - RNA, 1410 nt, Artificial Sequence; identical to SEQ ID NO: 166745
  derived and/or modified sequence opt4 from neuraminidase__InfluenzaA__AFD63562

SEQ ID NO: 174234 - RNA, 1410 nt, Artificial Sequence
  derived and/or modified sequence opt4 from neuraminidase__InfluenzaA__AFD63573
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucggcagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174235 - RNA, 1410 nt, Artificial Sequence
  derived and/or modified sequence opt4 from neuraminidase__InfluenzaA__AFD63584
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgagagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174236 - RNA, 1410 nt, Artificial Sequence
  derived and/or modified sequence opt4 from neuraminidase__InfluenzaA__AFD63595
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcaaggacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174237 - RNA, 1410 nt, Artificial Sequence; identical to SEQ ID NO: 166745
  derived and/or modified sequence opt4 from neuraminidase__InfluenzaA__AFD63606

SEQ ID NO: 174238 - RNA, 1410 nt, Artificial Sequence; identical to SEQ ID NO: 166665
  derived and/or modified sequence opt4 from neuraminidase__InfluenzaA__AFD63628

SEQ ID NO: 174239 - RNA, 1410 nt, Artificial Sequence; identical to SEQ ID NO: 166745
  derived and/or modified sequence opt4 from neuraminidase__InfluenzaA__AFD63639

SEQ ID NO: 174240 - RNA, 1410 nt, Artificial Sequence; identical to SEQ ID NO: 166745
  derived and/or modified sequence opt4 from neuraminidase__InfluenzaA__AFD63650

SEQ ID NO: 174241 - RNA, 1410 nt, Artificial Sequence
  derived and/or modified sequence opt4 from neuraminidase__InfluenzaA__AFD63661
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacagcaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174242 - RNA, 1410 nt, Artificial Sequence; identical to SEQ ID NO: 168451
  derived and/or modified sequence opt4 from neuraminidase__InfluenzaA__AFD63672

SEQ ID NO: 174243 - RNA, 1410 nt, Artificial Sequence
  derived and/or modified sequence opt4 from neuraminidase__InfluenzaA__AFD63683
augaaccccaaccagaagaucaucaccaugggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacggcagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174244 - RNA, 1410 nt, Artificial Sequence
  derived and/or modified sequence opt4 from neuraminidase__InfluenzaA__AFD63694
augaaccccaaccagaagaucaucaccaucggcagcgugagccugaccaucgccaccaucugcuuccugaugcagaucgccauccuggugaccaccaucacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174245 - RNA, 1410 nt, Artificial Sequence
  derived and/or modified sequence opt4 from neuraminidase__InfluenzaA__AFD63705
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggcaagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174246 - RNA, 1410 nt, Artificial Sequence
  derived and/or modified sequence opt4 from neuraminidase__InfluenzaA__AFD63716
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugccaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174247 - RNA, 1410 nt, Artificial Sequence; identical to SEQ ID NO: 166745
  derived and/or modified sequence opt4 from neuraminidase__InfluenzaA__AFD63727

SEQ ID NO: 174248 - RNA, 1410 nt, Artificial Sequence; identical to SEQ ID NO: 166745
  derived and/or modified sequence opt4 from neuraminidase__InfluenzaA__AFD63738

SEQ ID NO: 174249 - RNA, 1410 nt, Artificial Sequence
  derived and/or modified sequence opt4 from neuraminidase__InfluenzaA__AFD63749
augaaccccaaccagaagaucaucaccaucagcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174250 - RNA, 1410 nt, Artificial Sequence
  derived and/or modified sequence opt4 from neuraminidase__InfluenzaA__AFD63760
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174251 - RNA, 1410 nt, Artificial Sequence; identical to SEQ ID NO: 166745
  derived and/or modified sequence opt4 from neuraminidase__InfluenzaA__AFD63771

SEQ ID NO: 174252 - RNA, 1410 nt, Artificial Sequence; identical to SEQ ID NO: 166745
  derived and/or modified sequence opt4 from neuraminidase__InfluenzaA__AFD63782

SEQ ID NO: 174253 - RNA, 1410 nt, Artificial Sequence; identical to SEQ ID NO: 174250
  derived and/or modified sequence opt4 from neuraminidase__InfluenzaA__AFD63793

SEQ ID NO: 174254 - RNA, 1410 nt, Artificial Sequence; identical to SEQ ID NO: 166745
  derived and/or modified sequence opt4 from neuraminidase__InfluenzaA__AFD63804

SEQ ID NO: 174255 - RNA, 1410 nt, Artificial Sequence; identical to SEQ ID NO: 166745
  derived and/or modified sequence opt4 from neuraminidase__InfluenzaA__AFD63815

SEQ ID NO: 174256 - RNA, 1410 nt, Artificial Sequence; identical to SEQ ID NO: 166745
  derived and/or modified sequence opt4 from neuraminidase__InfluenzaA__AFD63826

SEQ ID NO: 174257 - RNA, 1410 nt, Artificial Sequence; identical to SEQ ID NO: 174250
  derived and/or modified sequence opt4 from neuraminidase__InfluenzaA__AFD63837

SEQ ID NO: 174258 - RNA, 1410 nt, Artificial Sequence
  derived and/or modified sequence opt4 from neuraminidase__InfluenzaA__AFD63848
augaaccccaaccagaagaucaucaccaucggcagcgugagccugaccaucgccgccaucugcuuccugaugcagaucgccauccuggugaccaccgugacccugcacuucaagcagagagagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggagaagaccgaggugugguggaccagcaacagcaucgugguguucugcggcaccagcggcaccuacggcaccggcagcuggcccgacggcgccgacaucaaccugaugcccaucuga

SEQ ID NO: 174259 - RNA, 1410 nt, Artificial Sequence; identical to SEQ ID NO: 166665
  derived and/or modified sequence opt4 from neuraminidase__InfluenzaA__AFD63859

SEQ ID NO: 174260 - RNA, 1410 nt, Artificial Sequence; identical to SEQ ID NO: 166665
  derived and/or modified sequence opt4 from neuraminidase__InfluenzaA__AFD63870

SEQ ID NO: 174261 - RNA, 1410 nt, Artificial Sequence; identical to SEQ ID NO: 166745
  derived and/or modified sequence opt4 from neuraminidase__InfluenzaA__AFD63881

SEQ ID NO: 174262 - RNA, 1410 nt, Artificial Sequence; identical to SEQ ID NO: 166745
  derived and/or modified sequence opt4 from neuraminidase__InfluenzaA__AFD63892

SEQ ID NO: 174263 - RNA, 1410 nt, Artificial Sequence
  derived and/or modified sequence opt4 from neuraminidase__InfluenzaA__AFD63903
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccggcaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174264 - RNA, 1410 nt, Artificial Sequence
  derived and/or modified sequence opt4 from neuraminidase__InfluenzaA__AFD63914
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggagaagaccgaggugugguggaccagcaacagcaucgugguguucugcggcaccagcggcaccuacggcaccggcagcuggcccgacggcgccgacaucaaccugaugcccaucuga

SEQ ID NO: 174265 - RNA, 1410 nt, Artificial Sequence; identical to SEQ ID NO: 174250
  derived and/or modified sequence opt4 from neuraminidase__InfluenzaA__AFD63925

SEQ ID NO: 174266 - RNA, 1410 nt, Artificial Sequence
  derived and/or modified sequence opt4 from neuraminidase__InfluenzaA__AFD63936
augaaccccaaccagaagaucaucaccaucggcagcgugagccugaccaucgccaccaucugcuuccugaugcagaucgccauccuggugaccaccgugacccugcacuucaagcagcacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174267 - RNA, 1410 nt, Artificial Sequence; identical to SEQ ID NO: 166745
  derived and/or modified sequence opt4 from neuraminidase__InfluenzaA__AFD63947

SEQ ID NO: 174268 - RNA, 1410 nt, Artificial Sequence; identical to SEQ ID NO: 166745
  derived and/or modified sequence opt4 from neuraminidase__InfluenzaA__AFD63958

SEQ ID NO: 174269 - RNA, 1410 nt, Artificial Sequence; identical to SEQ ID NO: 166745
  derived and/or modified sequence opt4 from neuraminidase__InfluenzaA__AFD63969

SEQ ID NO: 174270 - RNA, 1410 nt, Artificial Sequence; identical to SEQ ID NO: 166745
  derived and/or modified sequence opt4 from neuraminidase__InfluenzaA__AFD63980

SEQ ID NO: 174271 - RNA, 1410 nt, Artificial Sequence
  derived and/or modified sequence opt4 from neuraminidase__InfluenzaA__AFD64002
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaccgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174272 - RNA, 1410 nt, Artificial Sequence; identical to SEQ ID NO: 166655
  derived and/or modified sequence opt4 from neuraminidase__InfluenzaA__AFD64013

SEQ ID NO: 174273 - RNA, 1410 nt, Artificial Sequence
  derived and/or modified sequence opt4 from neuraminidase__InfluenzaA__AFD64024
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagaagaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174274 - RNA, 1410 nt, Artificial Sequence
  derived and/or modified sequence opt4 from neuraminidase__InfluenzaA__AFD64035
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcguggugguguucugcggcaccagcggcaccuacggcaccggcagcuggcccgacggcgccgacaucaaccugaugcccaucuga

SEQ ID NO: 174275 - RNA, 1410 nt, Artificial Sequence
  derived and/or modified sequence opt4 from neuraminidase__InfluenzaA__AFD64046
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgagagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174276 - RNA, 1410 nt, Artificial Sequence; identical to SEQ ID NO: 174250
  derived and/or modified sequence opt4 from neuraminidase__InfluenzaA__AFD64057

SEQ ID NO: 174277 - RNA, 1410 nt, Artificial Sequence
  derived and/or modified sequence opt4 from neuraminidase__InfluenzaA__AFD64068
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174278 - RNA, 1410 nt, Artificial Sequence
  derived and/or modified sequence opt4 from neuraminidase__InfluenzaA__AFD64079
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagaaucagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174279 - RNA, 1410 nt, Artificial Sequence; identical to SEQ ID NO: 166745
  derived and/or modified sequence opt4 from neuraminidase__InfluenzaA__AFD64090

SEQ ID NO: 174280 - RNA, 1410 nt, Artificial Sequence
  derived and/or modified sequence opt4 from neuraminidase__InfluenzaA__AFD64101
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacggcagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174281 - RNA, 1410 nt, Artificial Sequence
  derived and/or modified sequence opt4 from neuraminidase__InfluenzaA__AFD64112
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagagacaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174282 - RNA, 1410 nt, Artificial Sequence; identical to SEQ ID NO: 168451
  derived and/or modified sequence opt4 from neuraminidase__InfluenzaA__AFD64123

SEQ ID NO: 174283 - RNA, 1410 nt, Artificial Sequence; identical to SEQ ID NO: 166745
  derived and/or modified sequence opt4 from neuraminidase__InfluenzaA__AFD64134

SEQ ID NO: 174284 - RNA, 1410 nt, Artificial Sequence; identical to SEQ ID NO: 166745
  derived and/or modified sequence opt4 from neuraminidase__InfluenzaA__AFD64145

SEQ ID NO: 174285 - RNA, 1410 nt, Artificial Sequence; identical to SEQ ID NO: 166745
  derived and/or modified sequence opt4 from neuraminidase__InfluenzaA__AFD64156

SEQ ID NO: 174286 - RNA, 1410 nt, Artificial Sequence; identical to SEQ ID NO: 166665
  derived and/or modified sequence opt4 from neuraminidase__InfluenzaA__AFD64167

SEQ ID NO: 174287 - RNA, 1410 nt, Artificial Sequence; identical to SEQ ID NO: 166745
  derived and/or modified sequence opt4 from neuraminidase__InfluenzaA__AFD64181

SEQ ID NO: 174288 - RNA, 1410 nt, Artificial Sequence
  derived and/or modified sequence opt4 from neuraminidase__InfluenzaA__AFD64192
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacgugagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174289 - RNA, 1410 nt, Artificial Sequence
  derived and/or modified sequence opt4 from neuraminidase__InfluenzaA__AFD64203
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaacccugagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174290 - RNA, 1410 nt, Artificial Sequence; identical to SEQ ID NO: 174250
  derived and/or modified sequence opt4 from neuraminidase__InfluenzaA__AFD64214

SEQ ID NO: 174291 - RNA, 1410 nt, Artificial Sequence; identical to SEQ ID NO: 168449
  derived and/or modified sequence opt4 from neuraminidase__InfluenzaA__AFD64225

SEQ ID NO: 174292 - RNA, 1410 nt, Artificial Sequence; identical to SEQ ID NO: 166745
  derived and/or modified sequence opt4 from neuraminidase__InfluenzaA__AFD64317

SEQ ID NO: 174293 - RNA, 1410 nt, Artificial Sequence; identical to SEQ ID NO: 168451
  derived and/or modified sequence opt4 from neuraminidase__InfluenzaA__AFD64328

SEQ ID NO: 174294 - RNA, 1410 nt, Artificial Sequence; identical to SEQ ID NO: 174250
  derived and/or modified sequence opt4 from neuraminidase__InfluenzaA__AFD64339

SEQ ID NO: 174295 - RNA, 1410 nt, Artificial Sequence; identical to SEQ ID NO: 166745
  derived and/or modified sequence opt4 from neuraminidase__InfluenzaA__AFD64350

SEQ ID NO: 174296 - RNA, 1410 nt, Artificial Sequence; identical to SEQ ID NO: 174250
  derived and/or modified sequence opt4 from neuraminidase__InfluenzaA__AFD64361

SEQ ID NO: 174297 - RNA, 1410 nt, Artificial Sequence; identical to SEQ ID NO: 174250
  derived and/or modified sequence opt4 from neuraminidase__InfluenzaA__AFD64372

SEQ ID NO: 174298 - RNA, 1410 nt, Artificial Sequence; identical to SEQ ID NO: 166745
  derived and/or modified sequence opt4 from neuraminidase__InfluenzaA__AFD64383

SEQ ID NO: 174299 - RNA, 1410 nt, Artificial Sequence; identical to SEQ ID NO: 174250
  derived and/or modified sequence opt4 from neuraminidase__InfluenzaA__AFD64394

SEQ ID NO: 174300 - RNA, 1410 nt, Artificial Sequence; identical to SEQ ID NO: 166745
  derived and/or modified sequence opt4 from neuraminidase__InfluenzaA__AFD64405

SEQ ID NO: 174301 - RNA, 1410 nt, Artificial Sequence; identical to SEQ ID NO: 166745
  derived and/or modified sequence opt4 from neuraminidase__InfluenzaA__AFD64416

SEQ ID NO: 174302 - RNA, 1410 nt, Artificial Sequence; identical to SEQ ID NO: 166745
  derived and/or modified sequence opt4 from neuraminidase__InfluenzaA__AFD64427

SEQ ID NO: 174303 - RNA, 1410 nt, Artificial Sequence
  derived and/or modified sequence opt4 from neuraminidase__InfluenzaA__AFD64438
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaaccuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174304 - RNA, 1410 nt, Artificial Sequence; identical to SEQ ID NO: 166745
  derived and/or modified sequence opt4 from neuraminidase__InfluenzaA__AFD64449

SEQ ID NO: 174305 - RNA, 1410 nt, Artificial Sequence; identical to SEQ ID NO: 166665
  derived and/or modified sequence opt4 from neuraminidase__InfluenzaA__AFD64460

SEQ ID NO: 174306 - RNA, 1410 nt, Artificial Sequence; identical to SEQ ID NO: 173663
  derived and/or modified sequence opt4 from neuraminidase__InfluenzaA__AFD98098

SEQ ID NO: 174307 - RNA, 1410 nt, Artificial Sequence
  derived and/or modified sequence opt4 from neuraminidase__InfluenzaA__AFD98120
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174308 - RNA, 1410 nt, Artificial Sequence; identical to SEQ ID NO: 172038
  derived and/or modified sequence opt4 from neuraminidase__InfluenzaA__AFD98131

SEQ ID NO: 174309 - RNA, 1410 nt, Artificial Sequence; identical to SEQ ID NO: 173663
  derived and/or modified sequence opt4 from neuraminidase__InfluenzaA__AFD98142

SEQ ID NO: 174310 - RNA, 1410 nt, Artificial Sequence; identical to SEQ ID NO: 174307
  derived and/or modified sequence opt4 from neuraminidase__InfluenzaA__AFD98164

SEQ ID NO: 174311 - RNA, 1410 nt, Artificial Sequence
  derived and/or modified sequence opt4 from neuraminidase__InfluenzaA__AFD98175
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174312 - RNA, 1410 nt, Artificial Sequence
  derived and/or modified sequence opt4 from neuraminidase__InfluenzaA__AFD98186
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucguggaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucaucagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174313 - RNA, 1410 nt, Artificial Sequence; identical to SEQ ID NO: 172038
  derived and/or modified sequence opt4 from neuraminidase__InfluenzaA__AFD98197

SEQ ID NO: 174314 - RNA, 1410 nt, Artificial Sequence; identical to SEQ ID NO: 172775
  derived and/or modified sequence opt4 from neuraminidase__InfluenzaA__AFD98208

SEQ ID NO: 174315 - RNA, 1410 nt, Artificial Sequence
  derived and/or modified sequence opt4 from neuraminidase__InfluenzaA__AFD98218
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucgacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucguggugagcugcggcaccagcggcaccuacggcaccggcagcuggcccgacggcgccgaccugaaccugaugcccaucuga

SEQ ID NO: 174316 - RNA, 1410 nt, Artificial Sequence; identical to SEQ ID NO: 172038
  derived and/or modified sequence opt4 from neuraminidase__InfluenzaA__AFD98229

SEQ ID NO: 174317 - RNA, 1410 nt, Artificial Sequence; identical to SEQ ID NO: 172038
  derived and/or modified sequence opt4 from neuraminidase__InfluenzaA__AFD98240

SEQ ID NO: 174318 - RNA, 1410 nt, Artificial Sequence; identical to SEQ ID NO: 174307
  derived and/or modified sequence opt4 from neuraminidase__InfluenzaA__AFD98251

SEQ ID NO: 174319 - RNA, 1410 nt, Artificial Sequence; identical to SEQ ID NO: 174307
  derived and/or modified sequence opt4 from neuraminidase__InfluenzaA__AFD98262

SEQ ID NO: 174320 - RNA, 1410 nt, Artificial Sequence; identical to SEQ ID NO: 173229
  derived and/or modified sequence opt4 from neuraminidase__InfluenzaA__AFD98273

SEQ ID NO: 174321 - RNA, 1410 nt, Artificial Sequence; identical to SEQ ID NO: 172777
  derived and/or modified sequence opt4 from neuraminidase__InfluenzaA__AFD98283

SEQ ID NO: 174322 - RNA, 1410 nt, Artificial Sequence; identical to SEQ ID NO: 172038
  derived and/or modified sequence opt4 from neuraminidase__InfluenzaA__AFD98293

SEQ ID NO: 174323 - RNA, 1410 nt, Artificial Sequence; identical to SEQ ID NO: 173229
  derived and/or modified sequence opt4 from neuraminidase__InfluenzaA__AFD98313

SEQ ID NO: 174324 - RNA, 1410 nt, Artificial Sequence; identical to SEQ ID NO: 172777
  derived and/or modified sequence opt4 from neuraminidase__InfluenzaA__AFD98323

SEQ ID NO: 174325 - RNA, 1410 nt, Artificial Sequence; identical to SEQ ID NO: 173229
  derived and/or modified sequence opt4 from neuraminidase__InfluenzaA__AFD98333

SEQ ID NO: 174326 - RNA, 1410 nt, Artificial Sequence; identical to SEQ ID NO: 174307
  derived and/or modified sequence opt4 from neuraminidase__InfluenzaA__AFD98343

SEQ ID NO: 174327 - RNA, 1410 nt, Artificial Sequence
  derived and/or modified sequence opt4 from neuraminidase__InfluenzaA__AFD98354
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcaacgccagcggcaaggccgacaccaagauccuguucaucgaggagggcaagaucgugcacaccagcacccugcugggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174328 - RNA, 1410 nt, Artificial Sequence
  derived and/or modified sequence opt4 from neuraminidase__InfluenzaA__AFD98365
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccaaggugcuguggaccagcaacagcaucgugguguucugcggcaccagcggcaccuacggcaccggcagcuggcccgacggcgccgaccugaaccugaugcccaucuga

SEQ ID NO: 174329 - RNA, 1410 nt, Artificial Sequence
  derived and/or modified sequence opt4 from neuraminidase__InfluenzaA__AFD98376
augaaccccaaccagaagaucaucaccaucggcagcgugagccugaccaucagcaccaucugcuucuucaugcagaucgccauccugaucaccaccgugacccugcacuucaagcaguacgaguucaacuucccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174330 - RNA, 1410 nt, Artificial Sequence
  derived and/or modified sequence opt4 from neuraminidase__InfluenzaA__AFD98387
augaaccccaaccagaagaucaucaccaucggcagcgugagccugaccaucagcaccaucugcuuccugaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagagacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagaagcagcaacagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174331 - RNA, 1410 nt, Artificial Sequence
  derived and/or modified sequence opt4 from neuraminidase__InfluenzaA__AFD98398
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174332 - RNA, 1410 nt, Artificial Sequence
  derived and/or modified sequence opt4 from neuraminidase__InfluenzaA__AFD98409
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174333 - RNA, 1410 nt, Artificial Sequence; identical to SEQ ID NO: 174307
  derived and/or modified sequence opt4 from neuraminidase__InfluenzaA__AFD98420

SEQ ID NO: 174334 - RNA, 1410 nt, Artificial Sequence
  derived and/or modified sequence opt4 from neuraminidase__InfluenzaA__AFD98431
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucgugggcagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174335 - RNA, 1410 nt, Artificial Sequence
  derived and/or modified sequence opt4 from neuraminidase__InfluenzaA__AFD98442
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcggcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucgccaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174336 - RNA, 1410 nt, Artificial Sequence
  derived and/or modified sequence opt4 from neuraminidase__InfluenzaA__AFD98452
augaaccccaaccagaagaucaucacccugggcagcgugagccugaccaucagcaccaucugcuucuucauccagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174337 - RNA, 1410 nt, Artificial Sequence; identical to SEQ ID NO: 174307
  derived and/or modified sequence opt4 from neuraminidase__InfluenzaA__AFD98463

SEQ ID NO: 174338 - RNA, 1410 nt, Artificial Sequence
  derived and/or modified sequence opt4 from neuraminidase__InfluenzaA__AFD98474
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174339 - RNA, 1410 nt, Artificial Sequence
  derived and/or modified sequence opt4 from neuraminidase__InfluenzaA__AFD98484
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaugaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174340 - RNA, 1410 nt, Artificial Sequence
  derived and/or modified sequence opt4 from neuraminidase__InfluenzaA__AFD98495
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccaacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174341 - RNA, 1410 nt, Artificial Sequence; identical to SEQ ID NO: 174307
  derived and/or modified sequence opt4 from neuraminidase__InfluenzaA__AFD98506

SEQ ID NO: 174342 - RNA, 1410 nt, Artificial Sequence
  derived and/or modified sequence opt4 from neuraminidase__InfluenzaA__AFD98517
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174343 - RNA, 1410 nt, Artificial Sequence; identical to SEQ ID NO: 172038
  derived and/or modified sequence opt4 from neuraminidase__InfluenzaA__AFD98528

SEQ ID NO: 174344 - RNA, 1410 nt, Artificial Sequence; identical to SEQ ID NO: 174307
  derived and/or modified sequence opt4 from neuraminidase__InfluenzaA__AFD98539

SEQ ID NO: 174345 - RNA, 1410 nt, Artificial Sequence; identical to SEQ ID NO: 174307
  derived and/or modified sequence opt4 from neuraminidase__InfluenzaA__AFD98550

SEQ ID NO: 174346 - RNA, 1410 nt, Artificial Sequence
  derived and/or modified sequence opt4 from neuraminidase__InfluenzaA__AFD98561
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagagcgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174347 - RNA, 1410 nt, Artificial Sequence
  derived and/or modified sequence opt4 from neuraminidase__InfluenzaA__AFD98572
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccacccuggagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174348 - RNA, 1410 nt, Artificial Sequence
  derived and/or modified sequence opt4 from neuraminidase__InfluenzaA__AFD98583
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcagagacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagagcgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174349 - RNA, 1410 nt, Artificial Sequence
  derived and/or modified sequence opt4 from neuraminidase__InfluenzaA__AFE02944
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccugaacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 174350 - RNA, 1410 nt, Artificial Sequence
  derived and/or modified sequence opt4 from neuraminidase__InfluenzaA__AFE47627
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174351 - RNA, 1410 nt, Artificial Sequence; identical to SEQ ID NO: 173663
  derived and/or modified sequence opt4 from neuraminidase__InfluenzaA__AFF18509

SEQ ID NO: 174352 - RNA, 1410 nt, Artificial Sequence
  derived and/or modified sequence opt4 from neuraminidase__InfluenzaA__AFF57129
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaacggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174353 - RNA, 1410 nt, Artificial Sequence
  derived and/or modified sequence opt4 from neuraminidase__InfluenzaA__AFF57133
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccuggcugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccccagcgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174354 - RNA, 1410 nt, Artificial Sequence; identical to SEQ ID NO: 169413
  derived and/or modified sequence opt4 from neuraminidase__InfluenzaA__AFF57137

SEQ ID NO: 174355 - RNA, 1410 nt, Artificial Sequence; identical to SEQ ID NO: 169413
  derived and/or modified sequence opt4 from neuraminidase__InfluenzaA__AFF57141

SEQ ID NO: 174356 - RNA, 1410 nt, Artificial Sequence; identical to SEQ ID NO: 169413
  derived and/or modified sequence opt4 from neuraminidase__InfluenzaA__AFF57145

SEQ ID NO: 174357 - RNA, 1410 nt, Artificial Sequence; identical to SEQ ID NO: 169413
  derived and/or modified sequence opt4 from neuraminidase__InfluenzaA__AFF57149

SEQ ID NO: 174358 - RNA, 1410 nt, Artificial Sequence; identical to SEQ ID NO: 169413
  derived and/or modified sequence opt4 from neuraminidase__InfluenzaA__AFF57153

SEQ ID NO: 174359 - RNA, 1410 nt, Artificial Sequence; identical to SEQ ID NO: 169413
  derived and/or modified sequence opt4 from neuraminidase__InfluenzaA__AFF57157

SEQ ID NO: 174360 - RNA, 1410 nt, Artificial Sequence; identical to SEQ ID NO: 169413
  derived and/or modified sequence opt4 from neuraminidase__InfluenzaA__AFF57161

SEQ ID NO: 174361 - RNA, 1410 nt, Artificial Sequence; identical to SEQ ID NO: 169413
  derived and/or modified sequence opt4 from neuraminidase__InfluenzaA__AFF57165

SEQ ID NO: 174362 - RNA, 1410 nt, Artificial Sequence; identical to SEQ ID NO: 169413
  derived and/or modified sequence opt4 from neuraminidase__InfluenzaA__AFF57169

SEQ ID NO: 174363 - RNA, 1410 nt, Artificial Sequence; identical to SEQ ID NO: 169413
  derived and/or modified sequence opt4 from neuraminidase__InfluenzaA__AFF57173

SEQ ID NO: 174364 - RNA, 1410 nt, Artificial Sequence; identical to SEQ ID NO: 169413
  derived and/or modified sequence opt4 from neuraminidase__InfluenzaA__AFF57177

SEQ ID NO: 174365 - RNA, 1410 nt, Artificial Sequence; identical to SEQ ID NO: 169413
  derived and/or modified sequence opt4 from neuraminidase__InfluenzaA__AFF57181

SEQ ID NO: 174366 - RNA, 1410 nt, Artificial Sequence; identical to SEQ ID NO: 169413
  derived and/or modified sequence opt4 from neuraminidase__InfluenzaA__AFF57185

SEQ ID NO: 174367 - RNA, 1410 nt, Artificial Sequence; identical to SEQ ID NO: 169413
  derived and/or modified sequence opt4 from neuraminidase__InfluenzaA__AFF57189

SEQ ID NO: 174368 - RNA, 1350 nt, Artificial Sequence
  derived and/or modified sequence opt4 from neuraminidase__InfluenzaA__AFF60789
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaccagcgacaccgugggcuggagcuggcccgacggcgccgagcugcccuucaccaucgacaaguga

SEQ ID NO: 174369 - RNA, 1410 nt, Artificial Sequence
  derived and/or modified sequence opt4 from neuraminidase__InfluenzaA__AFG29043
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucagagacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174370 - RNA, 1410 nt, Artificial Sequence; identical to SEQ ID NO: 171039
  derived and/or modified sequence opt4 from neuraminidase__InfluenzaA__AFG29045

SEQ ID NO: 174371 - RNA, 1410 nt, Artificial Sequence; identical to SEQ ID NO: 171171
  derived and/or modified sequence opt4 from neuraminidase__InfluenzaA__AFG31063

SEQ ID NO: 174372 - RNA, 1410 nt, Artificial Sequence; identical to SEQ ID NO: 169258
  derived and/or modified sequence opt4 from neuraminidase__InfluenzaA__AFG31073

SEQ ID NO: 174373 - RNA, 1410 nt, Artificial Sequence
  derived and/or modified sequence opt4 from neuraminidase__InfluenzaA__AFG31083
augaaccccaaccagaagaucaucaccaucggcagcgugugcaugaccaucggcauggccaaccugauccugcagaucggcaacaucaucagcaucuggaucagccacagcauccagcuggugaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174374 - RNA, 1410 nt, Artificial Sequence; identical to SEQ ID NO: 169258
  derived and/or modified sequence opt4 from neuraminidase__InfluenzaA__AFG31093

SEQ ID NO: 174375 - RNA, 1410 nt, Artificial Sequence; identical to SEQ ID NO: 169258
  derived and/or modified sequence opt4 from neuraminidase__InfluenzaA__AFG31103

SEQ ID NO: 174376 - RNA, 1410 nt, Artificial Sequence; identical to SEQ ID NO: 169258
  derived and/or modified sequence opt4 from neuraminidase__InfluenzaA__AFG31113

SEQ ID NO: 174377 - RNA, 1410 nt, Artificial Sequence; identical to SEQ ID NO: 169258
  derived and/or modified sequence opt4 from neuraminidase__InfluenzaA__AFG31123

SEQ ID NO: 174378 - RNA, 1410 nt, Artificial Sequence; identical to SEQ ID NO: 169258
  derived and/or modified sequence opt4 from neuraminidase__InfluenzaA__AFG31133

SEQ ID NO: 174379 - RNA, 1410 nt, Artificial Sequence; identical to SEQ ID NO: 169258
  derived and/or modified sequence opt4 from neuraminidase__InfluenzaA__AFG31143

SEQ ID NO: 174380 - RNA, 1410 nt, Artificial Sequence; identical to SEQ ID NO: 169258
  derived and/or modified sequence opt4 from neuraminidase__InfluenzaA__AFG31153

SEQ ID NO: 174381 - RNA, 1410 nt, Artificial Sequence; identical to SEQ ID NO: 169258
  derived and/or modified sequence opt4 from neuraminidase__InfluenzaA__AFG31163

SEQ ID NO: 174382 - RNA, 1410 nt, Artificial Sequence
  derived and/or modified sequence opt4 from neuraminidase__InfluenzaA__AFG31173
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggccugcccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174383 - RNA, 1410 nt, Artificial Sequence; identical to SEQ ID NO: 174382
  derived and/or modified sequence opt4 from neuraminidase__InfluenzaA__AFG31183

SEQ ID NO: 174384 - RNA, 1410 nt, Artificial Sequence; identical to SEQ ID NO: 169258
  derived and/or modified sequence opt4 from neuraminidase__InfluenzaA__AFG31193

SEQ ID NO: 174385 - RNA, 1410 nt, Artificial Sequence; identical to SEQ ID NO: 169258
  derived and/or modified sequence opt4 from neuraminidase__InfluenzaA__AFG31203

SEQ ID NO: 174386 - RNA, 1410 nt, Artificial Sequence; identical to SEQ ID NO: 169258
  derived and/or modified sequence opt4 from neuraminidase__InfluenzaA__AFG31213

SEQ ID NO: 174387 - RNA, 1410 nt, Artificial Sequence; identical to SEQ ID NO: 169258
  derived and/or modified sequence opt4 from neuraminidase__InfluenzaA__AFG31223

SEQ ID NO: 174388 - RNA, 1410 nt, Artificial Sequence; identical to SEQ ID NO: 169258
  derived and/or modified sequence opt4 from neuraminidase__InfluenzaA__AFG31233

SEQ ID NO: 174389 - RNA, 1410 nt, Artificial Sequence
  derived and/or modified sequence opt4 from neuraminidase__InfluenzaA__AFG31243
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucguggccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174390 - RNA, 1410 nt, Artificial Sequence; identical to SEQ ID NO: 172250
  derived and/or modified sequence opt4 from neuraminidase__InfluenzaA__AFG31253

SEQ ID NO: 174391 - RNA, 1410 nt, Artificial Sequence; identical to SEQ ID NO: 169258
  derived and/or modified sequence opt4 from neuraminidase__InfluenzaA__AFG31263

SEQ ID NO: 174392 - RNA, 1410 nt, Artificial Sequence; identical to SEQ ID NO: 169258
  derived and/or modified sequence opt4 from neuraminidase__InfluenzaA__AFG31273

SEQ ID NO: 174393 - RNA, 1410 nt, Artificial Sequence; identical to SEQ ID NO: 169258
  derived and/or modified sequence opt4 from neuraminidase__InfluenzaA__AFG31283

SEQ ID NO: 174394 - RNA, 1410 nt, Artificial Sequence; identical to SEQ ID NO: 169258
  derived and/or modified sequence opt4 from neuraminidase__InfluenzaA__AFG31293

SEQ ID NO: 174395 - RNA, 1410 nt, Artificial Sequence; identical to SEQ ID NO: 169258
  derived and/or modified sequence opt4 from neuraminidase__InfluenzaA__AFG31303

SEQ ID NO: 174396 - RNA, 1410 nt, Artificial Sequence; identical to SEQ ID NO: 169258
  derived and/or modified sequence opt4 from neuraminidase__InfluenzaA__AFG31313

SEQ ID NO: 174397 - RNA, 1410 nt, Artificial Sequence; identical to SEQ ID NO: 169258
  derived and/or modified sequence opt4 from neuraminidase__InfluenzaA__AFG31326

SEQ ID NO: 174398 - RNA, 1410 nt, Artificial Sequence; identical to SEQ ID NO: 169258
  derived and/or modified sequence opt4 from neuraminidase__InfluenzaA__AFG31336

SEQ ID NO: 174399 - RNA, 1410 nt, Artificial Sequence; identical to SEQ ID NO: 172250
  derived and/or modified sequence opt4 from neuraminidase__InfluenzaA__AFG31346

SEQ ID NO: 174400 - RNA, 1410 nt, Artificial Sequence; identical to SEQ ID NO: 172250
  derived and/or modified sequence opt4 from neuraminidase__InfluenzaA__AFG31356

SEQ ID NO: 174401 - RNA, 1410 nt, Artificial Sequence; identical to SEQ ID NO: 172250
  derived and/or modified sequence opt4 from neuraminidase__InfluenzaA__AFG31366

SEQ ID NO: 174402 - RNA, 1410 nt, Artificial Sequence; identical to SEQ ID NO: 172250
  derived and/or modified sequence opt4 from neuraminidase__InfluenzaA__AFG31379

SEQ ID NO: 174403 - RNA, 1410 nt, Artificial Sequence; identical to SEQ ID NO: 172250
  derived and/or modified sequence opt4 from neuraminidase__InfluenzaA__AFG31389

SEQ ID NO: 174404 - RNA, 1410 nt, Artificial Sequence; identical to SEQ ID NO: 172250
  derived and/or modified sequence opt4 from neuraminidase__InfluenzaA__AFG31399

SEQ ID NO: 174405 - RNA, 1410 nt, Artificial Sequence; identical to SEQ ID NO: 172250
  derived and/or modified sequence opt4 from neuraminidase__InfluenzaA__AFG31409

SEQ ID NO: 174406 - RNA, 1410 nt, Artificial Sequence; identical to SEQ ID NO: 169258
  derived and/or modified sequence opt4 from neuraminidase__InfluenzaA__AFG31419

SEQ ID NO: 174407 - RNA, 1410 nt, Artificial Sequence; identical to SEQ ID NO: 169258
  derived and/or modified sequence opt4 from neuraminidase__InfluenzaA__AFG31429

SEQ ID NO: 174408 - RNA, 1410 nt, Artificial Sequence; identical to SEQ ID NO: 169258
  derived and/or modified sequence opt4 from neuraminidase__InfluenzaA__AFG31439

SEQ ID NO: 174409 - RNA, 1410 nt, Artificial Sequence; identical to SEQ ID NO: 169258
  derived and/or modified sequence opt4 from neuraminidase__InfluenzaA__AFG31449

SEQ ID NO: 174410 - RNA, 1410 nt, Artificial Sequence; identical to SEQ ID NO: 169258
  derived and/or modified sequence opt4 from neuraminidase__InfluenzaA__AFG31459

SEQ ID NO: 174411 - RNA, 1410 nt, Artificial Sequence; identical to SEQ ID NO: 169258
  derived and/or modified sequence opt4 from neuraminidase__InfluenzaA__AFG31469

SEQ ID NO: 174412 - RNA, 1410 nt, Artificial Sequence; identical to SEQ ID NO: 169258
  derived and/or modified sequence opt4 from neuraminidase__InfluenzaA__AFG31479

SEQ ID NO: 174413 - RNA, 1410 nt, Artificial Sequence; identical to SEQ ID NO: 169258
  derived and/or modified sequence opt4 from neuraminidase__InfluenzaA__AFG31499

SEQ ID NO: 174414 - RNA, 1410 nt, Artificial Sequence; identical to SEQ ID NO: 171149
  derived and/or modified sequence opt4 from neuraminidase__InfluenzaA__AFG31509

SEQ ID NO: 174415 - RNA, 1410 nt, Artificial Sequence; identical to SEQ ID NO: 172250
  derived and/or modified sequence opt4 from neuraminidase__InfluenzaA__AFG31519

SEQ ID NO: 174416 - RNA, 1410 nt, Artificial Sequence; identical to SEQ ID NO: 169258
  derived and/or modified sequence opt4 from neuraminidase__InfluenzaA__AFG31529

SEQ ID NO: 174417 - RNA, 1410 nt, Artificial Sequence; identical to SEQ ID NO: 171149
  derived and/or modified sequence opt4 from neuraminidase__InfluenzaA__AFG31539

SEQ ID NO: 174418 - RNA, 1410 nt, Artificial Sequence; identical to SEQ ID NO: 169258
  derived and/or modified sequence opt4 from neuraminidase__InfluenzaA__AFG31549

SEQ ID NO: 174419 - RNA, 1410 nt, Artificial Sequence; identical to SEQ ID NO: 169258
  derived and/or modified sequence opt4 from neuraminidase__InfluenzaA__AFG31559

SEQ ID NO: 174420 - RNA, 1410 nt, Artificial Sequence; identical to SEQ ID NO: 172250
  derived and/or modified sequence opt4 from neuraminidase__InfluenzaA__AFG31569

SEQ ID NO: 174421 - RNA, 1410 nt, Artificial Sequence; identical to SEQ ID NO: 169258
  derived and/or modified sequence opt4 from neuraminidase__InfluenzaA__AFG31579

SEQ ID NO: 174422 - RNA, 1410 nt, Artificial Sequence; identical to SEQ ID NO: 169258
  derived and/or modified sequence opt4 from neuraminidase__InfluenzaA__AFG31589

SEQ ID NO: 174423 - RNA, 1410 nt, Artificial Sequence; identical to SEQ ID NO: 169258
  derived and/or modified sequence opt4 from neuraminidase__InfluenzaA__AFG31599

SEQ ID NO: 174424 - RNA, 1410 nt, Artificial Sequence; identical to SEQ ID NO: 169258
  derived and/or modified sequence opt4 from neuraminidase__InfluenzaA__AFG31609

SEQ ID NO: 174425 - RNA, 1410 nt, Artificial Sequence; identical to SEQ ID NO: 169258
  derived and/or modified sequence opt4 from neuraminidase__InfluenzaA__AFG31619

SEQ ID NO: 174426 - RNA, 1410 nt, Artificial Sequence; identical to SEQ ID NO: 169258
  derived and/or modified sequence opt4 from neuraminidase__InfluenzaA__AFG31629

SEQ ID NO: 174427 - RNA, 1410 nt, Artificial Sequence; identical to SEQ ID NO: 172250
  derived and/or modified sequence opt4 from neuraminidase__InfluenzaA__AFG31639

SEQ ID NO: 174428 - RNA, 1410 nt, Artificial Sequence; identical to SEQ ID NO: 169258
  derived and/or modified sequence opt4 from neuraminidase__InfluenzaA__AFG31649

SEQ ID NO: 174429 - RNA, 1410 nt, Artificial Sequence; identical to SEQ ID NO: 169258
  derived and/or modified sequence opt4 from neuraminidase__InfluenzaA__AFG31659

SEQ ID NO: 174430 - RNA, 1410 nt, Artificial Sequence; identical to SEQ ID NO: 169258
  derived and/or modified sequence opt4 from neuraminidase__InfluenzaA__AFG31669

SEQ ID NO: 174431 - RNA, 1410 nt, Artificial Sequence; identical to SEQ ID NO: 166615
  derived and/or modified sequence opt4 from neuraminidase__InfluenzaA__AFG71868

SEQ ID NO: 174432 - RNA, 1410 nt, Artificial Sequence; identical to SEQ ID NO: 166615
  derived and/or modified sequence opt4 from neuraminidase__InfluenzaA__AFG71890

SEQ ID NO: 174433 - RNA, 1410 nt, Artificial Sequence; identical to SEQ ID NO: 166615
  derived and/or modified sequence opt4 from neuraminidase__InfluenzaA__AFG71901

SEQ ID NO: 174434 - RNA, 1410 nt, Artificial Sequence; identical to SEQ ID NO: 166634
  derived and/or modified sequence opt4 from neuraminidase__InfluenzaA__AFG71912

SEQ ID NO: 174435 - RNA, 1410 nt, Artificial Sequence
  derived and/or modified sequence opt4 from neuraminidase__InfluenzaA__AFG71934
augaaccccaaccagaagaucaucaccaucggcagcgugagccugaccaucgccaccgugugcuuccugaugcagaucgccauccugaucaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagauacgugugcagcggccuggugggcgacacccccagaaacaacgacagauucagcaacagcaacugcagaaaccccaacaacgagagaggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174436 - RNA, 1410 nt, Artificial Sequence
  derived and/or modified sequence opt4 from neuraminidase__InfluenzaA__AFG71945
augaaccccaaccagaagaucaucaccaucggcagcgugagccugaccaucgccaccgugugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagauacgugugcagcggccuggugggcgacacccccagaaacaacgacaagagcagcaacagcaacugcagaaaccccaacaacgacaagggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccaaggugugguggaccagcaacagcaucgugguguucugcggcaccagcggcaccuacggcaccggcagcuggcccgacggcgccgacaucaaccugaugagcaucuga

SEQ ID NO: 174437 - RNA, 1410 nt, Artificial Sequence; identical to SEQ ID NO: 166638
  derived and/or modified sequence opt4 from neuraminidase__InfluenzaA__AFG71967

SEQ ID NO: 174438 - RNA, 1410 nt, Artificial Sequence; identical to SEQ ID NO: 166638
  derived and/or modified sequence opt4 from neuraminidase__InfluenzaA__AFG71978

SEQ ID NO: 174439 - RNA, 1410 nt, Artificial Sequence
  derived and/or modified sequence opt4 from neuraminidase__InfluenzaA__AFG71988
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcaucugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174440 - RNA, 1410 nt, Artificial Sequence; identical to SEQ ID NO: 166638
  derived and/or modified sequence opt4 from neuraminidase__InfluenzaA__AFG71999

SEQ ID NO: 174441 - RNA, 1410 nt, Artificial Sequence; identical to SEQ ID NO: 167096
  derived and/or modified sequence opt4 from neuraminidase__InfluenzaA__AFG72021

SEQ ID NO: 174442 - RNA, 1410 nt, Artificial Sequence
  derived and/or modified sequence opt4 from neuraminidase__InfluenzaA__AFG72032
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174443 - RNA, 1410 nt, Artificial Sequence; identical to SEQ ID NO: 167333
  derived and/or modified sequence opt4 from neuraminidase__InfluenzaA__AFG72088

SEQ ID NO: 174444 - RNA, 1410 nt, Artificial Sequence
  derived and/or modified sequence opt4 from neuraminidase__InfluenzaA__AFG72121
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaacagagugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 174445 - RNA, 1410 nt, Artificial Sequence
  derived and/or modified sequence opt4 from neuraminidase__InfluenzaA__AFG72143
augaaccccaaccagaagaucaucaccaucggcagcgugagccugaccaucgccaccaucugccugcugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174446 - RNA, 1410 nt, Artificial Sequence
  derived and/or modified sequence opt4 from neuraminidase__InfluenzaA__AFG72165
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucgugagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaccaacagacaggugaucguggacagaggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174447 - RNA, 1410 nt, Artificial Sequence
  derived and/or modified sequence opt4 from neuraminidase__InfluenzaA__AFG72176
augaaccccaaccagaagaucaucaccaucggcagcgugagccugaccaucgccaccaucugcuuccugaugcagaucaccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaagugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaacaaggugugguggaccagcaacagcaucgugguguucugcggcaccagcggcaccuacggcaccggcagcuggcccgacggcgccgacaucaaccugaugcccaucuga

SEQ ID NO: 174448 - RNA, 1410 nt, Artificial Sequence; identical to SEQ ID NO: 174446
  derived and/or modified sequence opt4 from neuraminidase__InfluenzaA__AFG72198

SEQ ID NO: 174449 - RNA, 1410 nt, Artificial Sequence; identical to SEQ ID NO: 174446
  derived and/or modified sequence opt4 from neuraminidase__InfluenzaA__AFG72209

SEQ ID NO: 174450 - RNA, 1410 nt, Artificial Sequence
  derived and/or modified sequence opt4 from neuraminidase__InfluenzaA__AFG72220
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucgugcaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174451 - RNA, 1410 nt, Artificial Sequence; identical to SEQ ID NO: 174446
  derived and/or modified sequence opt4 from neuraminidase__InfluenzaA__AFG72231

SEQ ID NO: 174452 - RNA, 1410 nt, Artificial Sequence
  derived and/or modified sequence opt4 from neuraminidase__InfluenzaA__AFG72297
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagagagagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174453 - RNA, 1410 nt, Artificial Sequence
  derived and/or modified sequence opt4 from neuraminidase__InfluenzaA__AFG72308
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucagagugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174454 - RNA, 1410 nt, Artificial Sequence; identical to SEQ ID NO: 167705
  derived and/or modified sequence opt4 from neuraminidase__InfluenzaA__AFG72320

SEQ ID NO: 174455 - RNA, 1410 nt, Artificial Sequence
  derived and/or modified sequence opt4 from neuraminidase__InfluenzaA__AFG72331
augaaccccaaccagaagaucaucaccaucggcagcgugagccugaccguggccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174456 - RNA, 1410 nt, Artificial Sequence
  derived and/or modified sequence opt4 from neuraminidase__InfluenzaA__AFG72353
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgacagcggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174457 - RNA, 1410 nt, Artificial Sequence; identical to SEQ ID NO: 167705
  derived and/or modified sequence opt4 from neuraminidase__InfluenzaA__AFG72364

SEQ ID NO: 174458 - RNA, 1410 nt, Artificial Sequence
  derived and/or modified sequence opt4 from neuraminidase__InfluenzaA__AFG72430
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcaacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174459 - RNA, 1410 nt, Artificial Sequence; identical to SEQ ID NO: 167705
  derived and/or modified sequence opt4 from neuraminidase__InfluenzaA__AFG72452

SEQ ID NO: 174460 - RNA, 1410 nt, Artificial Sequence
  derived and/or modified sequence opt4 from neuraminidase__InfluenzaA__AFG72474
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174461 - RNA, 1410 nt, Artificial Sequence
  derived and/or modified sequence opt4 from neuraminidase__InfluenzaA__AFG72485
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174462 - RNA, 1410 nt, Artificial Sequence; identical to SEQ ID NO: 167621
  derived and/or modified sequence opt4 from neuraminidase__InfluenzaA__AFG72507

SEQ ID NO: 174463 - RNA, 1410 nt, Artificial Sequence
  derived and/or modified sequence opt4 from neuraminidase__InfluenzaA__AFG72529
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccagaaccccaacaacgagaacggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174464 - RNA, 1410 nt, Artificial Sequence
  derived and/or modified sequence opt4 from neuraminidase__InfluenzaA__AFG72540
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucaagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174465 - RNA, 1410 nt, Artificial Sequence
  derived and/or modified sequence opt4 from neuraminidase__InfluenzaA__AFG72562
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174466 - RNA, 1410 nt, Artificial Sequence
  derived and/or modified sequence opt4 from neuraminidase__InfluenzaA__AFG72584
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggaggugugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagaaggccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174467 - RNA, 1410 nt, Artificial Sequence
  derived and/or modified sequence opt4 from neuraminidase__InfluenzaA__AFG72606
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174468 - RNA, 1410 nt, Artificial Sequence
  derived and/or modified sequence opt4 from neuraminidase__InfluenzaA__AFG72617
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174469 - RNA, 1410 nt, Artificial Sequence
  derived and/or modified sequence opt4 from neuraminidase__InfluenzaA__AFG72628
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauacagcggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174470 - RNA, 1410 nt, Artificial Sequence; identical to SEQ ID NO: 167500
  derived and/or modified sequence opt4 from neuraminidase__InfluenzaA__AFG72639

SEQ ID NO: 174471 - RNA, 1410 nt, Artificial Sequence
  derived and/or modified sequence opt4 from neuraminidase__InfluenzaA__AFG72650
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174472 - RNA, 1410 nt, Artificial Sequence; identical to SEQ ID NO: 174469
  derived and/or modified sequence opt4 from neuraminidase__InfluenzaA__AFG72672

SEQ ID NO: 174473 - RNA, 1407 nt, Artificial Sequence
  derived and/or modified sequence opt4 from neuraminidase__InfluenzaA__AFG72683
augaaccccaaccagaagaucaucaccaucggcagcgugagccugaccaucgccaccaucugcuuccugaugcagaucgccauccuggugaucaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgaggugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174474 - RNA, 1410 nt, Artificial Sequence
  derived and/or modified sequence opt4 from neuraminidase__InfluenzaA__AFG72705
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174475 - RNA, 1410 nt, Artificial Sequence
  derived and/or modified sequence opt4 from neuraminidase__InfluenzaA__AFG72716
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccuggaccccaacaacgaggagggcggccacggcgugaagggcugggccuucgacgacggcaacgacguguggaugggcagaaccaucagcgagaagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaagacaggagaccgaggugugguggaccagcaacagcaucgugguguucugcggcaccagcggcaccuacggcaccggcagcuggcccgacggcgccgacaucaaccugaugcccaucuga

SEQ ID NO: 174476 - RNA, 1410 nt, Artificial Sequence
  derived and/or modified sequence opt4 from neuraminidase__InfluenzaA__AFG72738
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174477 - RNA, 1410 nt, Artificial Sequence; identical to SEQ ID NO: 167705
  derived and/or modified sequence opt4 from neuraminidase__InfluenzaA__AFG72749

SEQ ID NO: 174478 - RNA, 1410 nt, Artificial Sequence; identical to SEQ ID NO: 167093
  derived and/or modified sequence opt4 from neuraminidase__InfluenzaA__AFG72760

SEQ ID NO: 174479 - RNA, 1410 nt, Artificial Sequence; identical to SEQ ID NO: 166560
  derived and/or modified sequence opt4 from neuraminidase__InfluenzaA__AFG72771

SEQ ID NO: 174480 - RNA, 1410 nt, Artificial Sequence
  derived and/or modified sequence opt4 from neuraminidase__InfluenzaA__AFG72782
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaccagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174481 - RNA, 1410 nt, Artificial Sequence; identical to SEQ ID NO: 168269
  derived and/or modified sequence opt4 from neuraminidase__InfluenzaA__AFG72793

SEQ ID NO: 174482 - RNA, 1410 nt, Artificial Sequence; identical to SEQ ID NO: 166804
  derived and/or modified sequence opt4 from neuraminidase__InfluenzaA__AFG72804

SEQ ID NO: 174483 - RNA, 1410 nt, Artificial Sequence; identical to SEQ ID NO: 168449
  derived and/or modified sequence opt4 from neuraminidase__InfluenzaA__AFG72826

SEQ ID NO: 174484 - RNA, 1410 nt, Artificial Sequence
  derived and/or modified sequence opt4 from neuraminidase__InfluenzaA__AFG72837
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174485 - RNA, 1413 nt, Artificial Sequence
  derived and/or modified sequence opt4 from neuraminidase__InfluenzaA__AFG72848
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagagcgccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaaguacauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174486 - RNA, 1410 nt, Artificial Sequence
  derived and/or modified sequence opt4 from neuraminidase__InfluenzaA__AFG72859
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaucgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174487 - RNA, 1410 nt, Artificial Sequence
  derived and/or modified sequence opt4 from neuraminidase__InfluenzaA__AFG72870
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcaccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagagcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174488 - RNA, 1410 nt, Artificial Sequence
  derived and/or modified sequence opt4 from neuraminidase__InfluenzaA__AFG72892
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggagaagaccgaggugcuguggaccagcaacagcaucgugguguucugcggcaccagcggcaccuacggcaccggcagcuggcccgacggcgccgacaucaaccugaugcccaucuga

SEQ ID NO: 174489 - RNA, 1410 nt, Artificial Sequence
  derived and/or modified sequence opt4 from neuraminidase__InfluenzaA__AFG72903
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaaggacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174490 - RNA, 1410 nt, Artificial Sequence
  derived and/or modified sequence opt4 from neuraminidase__InfluenzaA__AFG72936
augaaccccaaccagaagaucaucaccaucggcagcgugagccugaccaucagcaccaucugcuucuucauccagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaucgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174491 - RNA, 1410 nt, Artificial Sequence
  derived and/or modified sequence opt4 from neuraminidase__InfluenzaA__AFG72958
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaucgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174492 - RNA, 1410 nt, Artificial Sequence; identical to SEQ ID NO: 166623
  derived and/or modified sequence opt4 from neuraminidase__InfluenzaA__AFG98811

SEQ ID NO: 174493 - RNA, 1410 nt, Artificial Sequence
  derived and/or modified sequence opt4 from neuraminidase__InfluenzaA__AFG98822
augaaccccaaccagaagaucaucaccaucggcagcgugagccugaucaucgccaccgugugcuuccugaugcagaucgccauccuggugaccaccgugacccugcacuucaagcagcacgagugcgacagccccagcagcaaccaggugaugcugugcgagcccaucaucaucgagagaaacaucaccgagaucguguaccugaacaacaccaccaucgagaaggagaccugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccaucguggacaucaacaugaaggacuacagcaucgacagcagcuacgugugcagcggccuggugggcgacacccccagaaacgacgacagaagcagcaagagcaacugcagaaaccccaacaacgagagaggcaaccacggcgugaagggcugggccuucgacaacggcaacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccaacaucaacuucaugcccaucuga

SEQ ID NO: 174494 - RNA, 1410 nt, Artificial Sequence; identical to SEQ ID NO: 172647
  derived and/or modified sequence opt4 from neuraminidase__InfluenzaA__AFG98833

SEQ ID NO: 174495 - RNA, 1410 nt, Artificial Sequence
  derived and/or modified sequence opt4 from neuraminidase__InfluenzaA__AFG98844
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaugugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacagaaccugcaccguggugaugaccgacggcagcgccagcggcaaggccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagagaggcaaccacggcgugaagggcugggccuucgacgacgagaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174496 - RNA, 1410 nt, Artificial Sequence; identical to SEQ ID NO: 166638
  derived and/or modified sequence opt4 from neuraminidase__InfluenzaA__AFG98855

SEQ ID NO: 174497 - RNA, 1410 nt, Artificial Sequence; identical to SEQ ID NO: 167492
  derived and/or modified sequence opt4 from neuraminidase__InfluenzaA__AFG98866

SEQ ID NO: 174498 - RNA, 1410 nt, Artificial Sequence
  derived and/or modified sequence opt4 from neuraminidase__InfluenzaA__AFG98877
augaaccccaaccagaagaucaucaccaucggcagcgugagccugaccaucgccaccaucugcuuccugaugcagaucgccauccuggugaccaccgugacccugcacuucaagcaguacgagugcgacagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174499 - RNA, 1410 nt, Artificial Sequence; identical to SEQ ID NO: 166638
  derived and/or modified sequence opt4 from neuraminidase__InfluenzaA__AFG98888

SEQ ID NO: 174500 - RNA, 1410 nt, Artificial Sequence
  derived and/or modified sequence opt4 from neuraminidase__InfluenzaA__AFG98899
augaaccccaaccagaagaucaucaccaucggcagcgugagccugaucaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174501 - RNA, 1410 nt, Artificial Sequence; identical to SEQ ID NO: 166638
  derived and/or modified sequence opt4 from neuraminidase__InfluenzaA__AFG98910

SEQ ID NO: 174502 - RNA, 1410 nt, Artificial Sequence; identical to SEQ ID NO: 166638
  derived and/or modified sequence opt4 from neuraminidase__InfluenzaA__AFG98921

SEQ ID NO: 174503 - RNA, 1410 nt, Artificial Sequence
  derived and/or modified sequence opt4 from neuraminidase__InfluenzaA__AFG98932
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucguggagagaaacaucaccgagaucguguaccugaccaacaccaccaucgagaaggagaucugccccaagcugguggaguacagaaaguggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174504 - RNA, 1410 nt, Artificial Sequence
  derived and/or modified sequence opt4 from neuraminidase__InfluenzaA__AFG98943
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaagaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucgaccugaugcccaucuga

SEQ ID NO: 174505 - RNA, 1410 nt, Artificial Sequence
  derived and/or modified sequence opt4 from neuraminidase__InfluenzaA__AFG98965
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaccaucaucgagagaaacaucaccgagaucguguaccugaccaacaucaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcgccggcagcuggcccgacggcgccgacaucaaccugaugcccaucuga

SEQ ID NO: 174506 - RNA, 1410 nt, Artificial Sequence
  derived and/or modified sequence opt4 from neuraminidase__InfluenzaA__AFG98976
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccuggccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcguguucagcguggagggcaagagcugcaucaacagaugcuucuacguggagcugaucagaggcagagagcuggagaccagagugugguggaccagcaacagcaucgugguguucugcggcaccagcggcaccuacggcaccggcagcuggcccgacggcgccgacaucaaccugaugcccaucuga

SEQ ID NO: 174507 - RNA, 1410 nt, Artificial Sequence; identical to SEQ ID NO: 174506
  derived and/or modified sequence opt4 from neuraminidase__InfluenzaA__AFG98987

SEQ ID NO: 174508 - RNA, 1410 nt, Artificial Sequence
  derived and/or modified sequence opt4 from neuraminidase__InfluenzaA__AFG98998
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggagaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgccaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174509 - RNA, 1410 nt, Artificial Sequence; identical to SEQ ID NO: 174506
  derived and/or modified sequence opt4 from neuraminidase__InfluenzaA__AFG99009

SEQ ID NO: 174510 - RNA, 1410 nt, Artificial Sequence
  derived and/or modified sequence opt4 from neuraminidase__InfluenzaA__AFG99020
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaccagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcacccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaacaucaugcccaucuga

SEQ ID NO: 174511 - RNA, 1410 nt, Artificial Sequence
  derived and/or modified sequence opt4 from neuraminidase__InfluenzaA__AFG99031
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaccagcccccugagcggcagcgcccagcacguggaggagugcagcugcuaccccagauaccccggcgugagaugcaucugcagagacaacuggagaggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcacccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcuggugagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174512 - RNA, 1410 nt, Artificial Sequence; identical to SEQ ID NO: 167096
  derived and/or modified sequence opt4 from neuraminidase__InfluenzaA__AFG99042

SEQ ID NO: 174513 - RNA, 1410 nt, Artificial Sequence
  derived and/or modified sequence opt4 from neuraminidase__InfluenzaA__AFG99053
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaccagcagccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcacccacggcgugaagggcugggccuucgacgacggcaacgacguguggaugggcagaaccaucagcgaggacagcagaagcggcuacgagaccuucaaggugaucggcggcuggagcauccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174514 - RNA, 1410 nt, Artificial Sequence
  derived and/or modified sequence opt4 from neuraminidase__InfluenzaA__AFG99064
augaaccccaaccagaagaucaucaccaucggcagcgugagccugaccaucgccaccgugugcuuccugaugcagaucgccauccuggugaccaccgugacccugcacuucaagcaguacgagugcgacagcccccccaacaaccaggugaugcccugcgagcccaucaucaucgagagaaacgugaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcaucaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174515 - RNA, 1410 nt, Artificial Sequence
  derived and/or modified sequence opt4 from neuraminidase__InfluenzaA__AFG99086
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacgugaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174516 - RNA, 1410 nt, Artificial Sequence
  derived and/or modified sequence opt4 from neuraminidase__InfluenzaA__AFG99097
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacgugaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagacugggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174517 - RNA, 1410 nt, Artificial Sequence
  derived and/or modified sequence opt4 from neuraminidase__InfluenzaA__AFG99119
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174518 - RNA, 1410 nt, Artificial Sequence
  derived and/or modified sequence opt4 from neuraminidase__InfluenzaA__AFG99130
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcggccccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaccaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174519 - RNA, 1410 nt, Artificial Sequence
  derived and/or modified sequence opt4 from neuraminidase__InfluenzaA__AFG99141
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgagaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174520 - RNA, 1410 nt, Artificial Sequence
  derived and/or modified sequence opt4 from neuraminidase__InfluenzaA__AFG99152
augaaccccaaccagaagaucaugaccaucggcagcgugagccugaccaucgccaccaucugcuuccugaugcagaucgccauccuggugaccaccgugacccugcacuucaagcacuacgaguucagcagcccccccaacaaccaggugaugcccugcgagcccaucaucaucgagagaaacaucaccgagaucguguaccugaccaacaccaccaucgagaaggaggugugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugcuguggaccagcaacagcaucgugguguucugcggcaccagcggcaccuacggcaccggcagcuggcccgacggcgccgacaucaaccugaugcccaucuga

SEQ ID NO: 174521 - RNA, 1410 nt, Artificial Sequence; identical to SEQ ID NO: 171515
  derived and/or modified sequence opt4 from neuraminidase__InfluenzaA__AFG99163

SEQ ID NO: 174522 - RNA, 1410 nt, Artificial Sequence
  derived and/or modified sequence opt4 from neuraminidase__InfluenzaA__AFG99174
augaaccccagccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugauggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgagaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174523 - RNA, 1410 nt, Artificial Sequence
  derived and/or modified sequence opt4 from neuraminidase__InfluenzaA__AFG99185
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcaagaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174524 - RNA, 1410 nt, Artificial Sequence
  derived and/or modified sequence opt4 from neuraminidase__InfluenzaA__AFG99196
augaaccccaaccagaagaucaucaccaucggcagcgugagccugaccaucgccaccaucugcuuccugacccagaucgccauccuggugaccaccgugacccugcacuucaagcaguacgagugcagcagcagccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcaucaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174525 - RNA, 1410 nt, Artificial Sequence
  derived and/or modified sequence opt4 from neuraminidase__InfluenzaA__AFG99207
augaaccccaaccagaagaucaucaccaucggcagcgugagccugaccaucgccaccaucugcuuccugaugcagaucgccauccuggugaccaccgugacccugcacuucaagcccuacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcaagagcagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174526 - RNA, 1410 nt, Artificial Sequence; identical to SEQ ID NO: 167334
  derived and/or modified sequence opt4 from neuraminidase__InfluenzaA__AFG99218

SEQ ID NO: 174527 - RNA, 1410 nt, Artificial Sequence
  derived and/or modified sequence opt4 from neuraminidase__InfluenzaA__AFG99229
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccaagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcaagaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174528 - RNA, 1410 nt, Artificial Sequence
  derived and/or modified sequence opt4 from neuraminidase__InfluenzaA__AFG99240
augaaccccaaccagaagaucaucaccaucggcagcgugagccugaccaucgccaccaucugcuuccugaugcagaucgccauccuggugaccaccgugacccugcacuucaagcaguacgagugcagcagcccccccagcaaccaggugaugcccugcgagcccaucaucaucgagagaaacaucaccgagaucguguaccugaccaacaccaccaucgagaaggagaucugccccaagcccguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagauucagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcaagaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174529 - RNA, 1410 nt, Artificial Sequence; identical to SEQ ID NO: 167333
  derived and/or modified sequence opt4 from neuraminidase__InfluenzaA__AFG99251

SEQ ID NO: 174530 - RNA, 1410 nt, Artificial Sequence
  derived and/or modified sequence opt4 from neuraminidase__InfluenzaA__AFG99273
augaaccccaaccagaagaucaucaccaucggcagcgugagccugaccaucgccaccaugugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174531 - RNA, 1410 nt, Artificial Sequence
  derived and/or modified sequence opt4 from neuraminidase__InfluenzaA__AFG99284
augaaccccaaccagaagaucaucaccaucggcagcgugagccugaccaucgccaccaucugcuuccugaugcagaucgccauccuggugaccaccgugacccugcacuucaagcaguacgagugcagcagcccccccagcaaccaggugaugcccugcgagcccaucaucaucgagagaaacaucaccaagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgacaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcaagaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174532 - RNA, 1410 nt, Artificial Sequence
  derived and/or modified sequence opt4 from neuraminidase__InfluenzaA__AFG99295
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucaucagcagcuacgugugcagcggccuggugggcgacacccccagaaagaacgacagaagcagcagcagcuacugccagaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 174533 - RNA, 1410 nt, Artificial Sequence
  derived and/or modified sequence opt4 from neuraminidase__InfluenzaA__AFG99317
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucgacgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 174534 - RNA, 1410 nt, Artificial Sequence
  derived and/or modified sequence opt4 from neuraminidase__InfluenzaA__AFG99328
augaaccccaaccagaagaucaucaccaucggcagcgugagccugacccuggccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccugaacaacagacacagcaacgacaccgugcacgacagaacccccuacagaacccugcugaugaacgagcugggcgugcccuuccaccugggcaccagacaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaacgugcugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcaacgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 174535 - RNA, 1410 nt, Artificial Sequence
  derived and/or modified sequence opt4 from neuraminidase__InfluenzaA__AFG99350
augaaccccaaccagaagaucaucaccaucggcagcgugagccugacccuggccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccugaacaacagacacagcaacgacaccgugcacgacagaacccccuacagaacccugcugaugaacgagcugggcgugcccuuccaccugggcaccagacaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 174536 - RNA, 1410 nt, Artificial Sequence
  derived and/or modified sequence opt4 from neuraminidase__InfluenzaA__AFG99361
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaagugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174537 - RNA, 1410 nt, Artificial Sequence
  derived and/or modified sequence opt4 from neuraminidase__InfluenzaA__AFG99383
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174538 - RNA, 1410 nt, Artificial Sequence; identical to SEQ ID NO: 174537
  derived and/or modified sequence opt4 from neuraminidase__InfluenzaA__AFG99394

SEQ ID NO: 174539 - RNA, 1410 nt, Artificial Sequence
  derived and/or modified sequence opt4 from neuraminidase__InfluenzaA__AFG99405
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucaucagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174540 - RNA, 1410 nt, Artificial Sequence
  derived and/or modified sequence opt4 from neuraminidase__InfluenzaA__AFG99416
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucauccacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacggcggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174541 - RNA, 1410 nt, Artificial Sequence
  derived and/or modified sequence opt4 from neuraminidase__InfluenzaA__AFG99427
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggaggugugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucauccacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174542 - RNA, 1410 nt, Artificial Sequence
  derived and/or modified sequence opt4 from neuraminidase__InfluenzaA__AFG99438
augaaccccaaccagaagaucaucaccaucggcagcgugagccugaccaucgccaccaucugcuuccugaugcagaucgccauccuggugaccaccgugacccugcacuucagacaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 174543 - RNA, 1410 nt, Artificial Sequence
  derived and/or modified sequence opt4 from neuraminidase__InfluenzaA__AFG99449
augaaccccaaccagaagaucaucaccaucggcagcgugagccugaccaucgccaccaucugcuuccugaugcagaucgccauccuggugaccaccgugacccugcacuucagacaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagaacugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 174544 - RNA, 1410 nt, Artificial Sequence
  derived and/or modified sequence opt4 from neuraminidase__InfluenzaA__AFG99471
augaaccccaaccagaagaucaucaccaucggcagcgugagccugauccuggccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaaaccccuacagaacccugcugaugaacgagcugggcgugcccuuccaccugggcaccagacaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 174545 - RNA, 1410 nt, Artificial Sequence
  derived and/or modified sequence opt4 from neuraminidase__InfluenzaA__AFG99482
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagaacugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugagcaucuga

SEQ ID NO: 174546 - RNA, 1410 nt, Artificial Sequence
  derived and/or modified sequence opt4 from neuraminidase__InfluenzaA__AFG99493
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174547 - RNA, 1410 nt, Artificial Sequence
  derived and/or modified sequence opt4 from neuraminidase__InfluenzaA__AFG99504
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 174548 - RNA, 1410 nt, Artificial Sequence
  derived and/or modified sequence opt4 from neuraminidase__InfluenzaA__AFG99515
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174549 - RNA, 1410 nt, Artificial Sequence
  derived and/or modified sequence opt4 from neuraminidase__InfluenzaA__AFG99526
augaaccccaaccagaagaucaucaccaucggcagcgugagccugacccuggccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggaggugugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccagacaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 174550 - RNA, 1410 nt, Artificial Sequence; identical to SEQ ID NO: 174446
  derived and/or modified sequence opt4 from neuraminidase__InfluenzaA__AFG99537

SEQ ID NO: 174551 - RNA, 1410 nt, Artificial Sequence; identical to SEQ ID NO: 174446
  derived and/or modified sequence opt4 from neuraminidase__InfluenzaA__AFG99548

SEQ ID NO: 174552 - RNA, 1410 nt, Artificial Sequence; identical to SEQ ID NO: 174446
  derived and/or modified sequence opt4 from neuraminidase__InfluenzaA__AFG99559

SEQ ID NO: 174553 - RNA, 1410 nt, Artificial Sequence; identical to SEQ ID NO: 174446
  derived and/or modified sequence opt4 from neuraminidase__InfluenzaA__AFG99570

SEQ ID NO: 174554 - RNA, 1410 nt, Artificial Sequence; identical to SEQ ID NO: 174446
  derived and/or modified sequence opt4 from neuraminidase__InfluenzaA__AFG99581

SEQ ID NO: 174555 - RNA, 1410 nt, Artificial Sequence
  derived and/or modified sequence opt4 from neuraminidase__InfluenzaA__AFG99592
augaaccccaaccagaagaucaucaccaucggcagcgugagccugaccaucgccaccaccugcuuccugaugcagaucgccauccuggugaccaccgugacccugcacuucaagcaguacgagugcaacagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucgugagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaccaacagacaggugaucguggacagaggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174556 - RNA, 1410 nt, Artificial Sequence; identical to SEQ ID NO: 174446
  derived and/or modified sequence opt4 from neuraminidase__InfluenzaA__AFG99603

SEQ ID NO: 174557 - RNA, 1410 nt, Artificial Sequence; identical to SEQ ID NO: 174446
  derived and/or modified sequence opt4 from neuraminidase__InfluenzaA__AFG99614

SEQ ID NO: 174558 - RNA, 1410 nt, Artificial Sequence; identical to SEQ ID NO: 174446
  derived and/or modified sequence opt4 from neuraminidase__InfluenzaA__AFG99625

SEQ ID NO: 174559 - RNA, 1410 nt, Artificial Sequence
  derived and/or modified sequence opt4 from neuraminidase__InfluenzaA__AFG99636
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucgugagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggaccugagaagcggcuacgagaccuucaaggugaucggcggcuggagcacccccaacagcaagcugcagaccaacagacaggugaucguggacagaggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174560 - RNA, 1410 nt, Artificial Sequence
  derived and/or modified sequence opt4 from neuraminidase__InfluenzaA__AFG99658
augaaccccaaccagaagaucaucaccaucggcagcgugagccugaccaucgccaccaucugcuuccugaugcagaucaccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucagcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaacaaggugugguggaccagcaacagcaucgugguguucugcggcaccagcggcaccuacggcaccggcagcuggcccgacggcgccgacaucaaccugaugcccaucuga

SEQ ID NO: 174561 - RNA, 1410 nt, Artificial Sequence
  derived and/or modified sequence opt4 from neuraminidase__InfluenzaA__AFG99680
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugauccugugccagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagguggugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174562 - RNA, 1410 nt, Artificial Sequence
  derived and/or modified sequence opt4 from neuraminidase__InfluenzaA__AFG99691
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcccugcgagcccaccaucaucgagagaaacaccaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucgugagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaccaacagacaggugaucguggacagaggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174563 - RNA, 1410 nt, Artificial Sequence; identical to SEQ ID NO: 174446
  derived and/or modified sequence opt4 from neuraminidase__InfluenzaA__AFG99704

SEQ ID NO: 174564 - RNA, 1410 nt, Artificial Sequence; identical to SEQ ID NO: 174446
  derived and/or modified sequence opt4 from neuraminidase__InfluenzaA__AFG99715

SEQ ID NO: 174565 - RNA, 1410 nt, Artificial Sequence; identical to SEQ ID NO: 174446
  derived and/or modified sequence opt4 from neuraminidase__InfluenzaA__AFG99726

SEQ ID NO: 174566 - RNA, 1410 nt, Artificial Sequence
  derived and/or modified sequence opt4 from neuraminidase__InfluenzaA__AFG99737
augaaccccaaccagaagaucaucaccaucggcagcgugagccugaccaucgccaccaucugcuuccugaugcagaucaccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaacaaggugugguggaccagcaacagcaucgugguguucugcggcaccagcggcaccuacggcaccggcagcuggcccgacggcgccgacaucaaccugaugcccaucuga

SEQ ID NO: 174567 - RNA, 1410 nt, Artificial Sequence
  derived and/or modified sequence opt4 from neuraminidase__InfluenzaA__AFG99748
augaaccccaaccagaagaucaucaccaucggcagcgugagccugaccaucgccaccaucugcuuccugaugcagaucgccauccuggugaccaccgugacccugcacuucaagcaguacgacugcaacagcccccccaacaaccaggccaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaccaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174568 - RNA, 1410 nt, Artificial Sequence; identical to SEQ ID NO: 174446
  derived and/or modified sequence opt4 from neuraminidase__InfluenzaA__AFG99759

SEQ ID NO: 174569 - RNA, 1410 nt, Artificial Sequence
  derived and/or modified sequence opt4 from neuraminidase__InfluenzaA__AFG99770
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccagaucaugcugugcgagcccaccaucaucgagagaaacaucaccgagaucguguaccugaccaacaccaccaucgagagagagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174570 - RNA, 1410 nt, Artificial Sequence
  derived and/or modified sequence opt4 from neuraminidase__InfluenzaA__AFG99781
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugccagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcaagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaccaacagacaggugaucguggacagcggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174571 - RNA, 1410 nt, Artificial Sequence; identical to SEQ ID NO: 174446
  derived and/or modified sequence opt4 from neuraminidase__InfluenzaA__AFG99792

SEQ ID NO: 174572 - RNA, 1410 nt, Artificial Sequence; identical to SEQ ID NO: 174566
  derived and/or modified sequence opt4 from neuraminidase__InfluenzaA__AFG99803

SEQ ID NO: 174573 - RNA, 1410 nt, Artificial Sequence; identical to SEQ ID NO: 174446
  derived and/or modified sequence opt4 from neuraminidase__InfluenzaA__AFG99825

SEQ ID NO: 174574 - RNA, 1410 nt, Artificial Sequence; identical to SEQ ID NO: 174446
  derived and/or modified sequence opt4 from neuraminidase__InfluenzaA__AFG99836

SEQ ID NO: 174575 - RNA, 1410 nt, Artificial Sequence; identical to SEQ ID NO: 174446
  derived and/or modified sequence opt4 from neuraminidase__InfluenzaA__AFG99847

SEQ ID NO: 174576 - RNA, 1410 nt, Artificial Sequence; identical to SEQ ID NO: 174446
  derived and/or modified sequence opt4 from neuraminidase__InfluenzaA__AFG99858

SEQ ID NO: 174577 - RNA, 1410 nt, Artificial Sequence; identical to SEQ ID NO: 174446
  derived and/or modified sequence opt4 from neuraminidase__InfluenzaA__AFG99869

SEQ ID NO: 174578 - RNA, 1410 nt, Artificial Sequence; identical to SEQ ID NO: 174446
  derived and/or modified sequence opt4 from neuraminidase__InfluenzaA__AFG99880

SEQ ID NO: 174579 - RNA, 1410 nt, Artificial Sequence
  derived and/or modified sequence opt4 from neuraminidase__InfluenzaA__AFG99891
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguacuucaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucagagugaucggcggcuggagcacccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174580 - RNA, 1410 nt, Artificial Sequence; identical to SEQ ID NO: 174446
  derived and/or modified sequence opt4 from neuraminidase__InfluenzaA__AFG99902

SEQ ID NO: 174581 - RNA, 1410 nt, Artificial Sequence; identical to SEQ ID NO: 174446
  derived and/or modified sequence opt4 from neuraminidase__InfluenzaA__AFG99913

SEQ ID NO: 174582 - RNA, 1410 nt, Artificial Sequence; identical to SEQ ID NO: 174446
  derived and/or modified sequence opt4 from neuraminidase__InfluenzaA__AFG99924

SEQ ID NO: 174583 - RNA, 1410 nt, Artificial Sequence
  derived and/or modified sequence opt4 from neuraminidase__InfluenzaA__AFG99935
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucguggagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacaugaaggacuacagcaucgugagcagcuacgugugcagcggccuggugggcgacacccccagaaacaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174584 - RNA, 1410 nt, Artificial Sequence; identical to SEQ ID NO: 174446
  derived and/or modified sequence opt4 from neuraminidase__InfluenzaA__AFG99946

SEQ ID NO: 174585 - RNA, 1410 nt, Artificial Sequence
  derived and/or modified sequence opt4 from neuraminidase__InfluenzaA__AFG99957
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggccaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaccaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174586 - RNA, 1410 nt, Artificial Sequence; identical to SEQ ID NO: 174446
  derived and/or modified sequence opt4 from neuraminidase__InfluenzaA__AFG99968

SEQ ID NO: 174587 - RNA, 1410 nt, Artificial Sequence
  derived and/or modified sequence opt4 from neuraminidase__InfluenzaA__AFG99979
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucgugagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaccaacagacaggugaucguggacagaggcaacagaagcggcuacagcggcaucuucagcguggagagcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174588 - RNA, 1410 nt, Artificial Sequence
  derived and/or modified sequence opt4 from neuraminidase__InfluenzaA__AFG99990
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggccaugcugugcgagcccaagaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174589 - RNA, 1410 nt, Artificial Sequence
  derived and/or modified sequence opt4 from neuraminidase__InfluenzaA__AFH00002
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugauccccugccagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcgccguggugaugaccgacggcagcgccagcgagagagccgacaccaagauccuguucaucgaggagggcaagguggugcacaucagcccccugagcggcagcgcccagcacguggaggagugcagcugcuaccccagauaccccggcgugagaugcgugugcagagacaacuggaagggcagcaacagacccaucguggacaucaacgugaagaacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174590 - RNA, 1410 nt, Artificial Sequence; identical to SEQ ID NO: 167705
  derived and/or modified sequence opt4 from neuraminidase__InfluenzaA__AFH00013

SEQ ID NO: 174591 - RNA, 1410 nt, Artificial Sequence
  derived and/or modified sequence opt4 from neuraminidase__InfluenzaA__AFH00024
augaaccccaaccagaagaucaucaccaucggcagcgugagccugaccaucgccaccaucugcuuccugaugcagaucaccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcagaaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaacaaggugugguggaccagcaacagcaucgugguguucugcggcaccagcggcaccuacggcaccggcagcuggcccgacggcgccgacaucaaccugaugcccaucuga

SEQ ID NO: 174592 - RNA, 1410 nt, Artificial Sequence; identical to SEQ ID NO: 167705
  derived and/or modified sequence opt4 from neuraminidase__InfluenzaA__AFH00035

SEQ ID NO: 174593 - RNA, 1410 nt, Artificial Sequence; identical to SEQ ID NO: 167705
  derived and/or modified sequence opt4 from neuraminidase__InfluenzaA__AFH00046

SEQ ID NO: 174594 - RNA, 1410 nt, Artificial Sequence
  derived and/or modified sequence opt4 from neuraminidase__InfluenzaA__AFH00057
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacgugcugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174595 - RNA, 1410 nt, Artificial Sequence; identical to SEQ ID NO: 167705
  derived and/or modified sequence opt4 from neuraminidase__InfluenzaA__AFH00068

SEQ ID NO: 174596 - RNA, 1410 nt, Artificial Sequence
  derived and/or modified sequence opt4 from neuraminidase__InfluenzaA__AFH00079
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174597 - RNA, 1410 nt, Artificial Sequence
  derived and/or modified sequence opt4 from neuraminidase__InfluenzaA__AFH00090
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174598 - RNA, 1410 nt, Artificial Sequence
  derived and/or modified sequence opt4 from neuraminidase__InfluenzaA__AFH00101
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174599 - RNA, 1410 nt, Artificial Sequence; identical to SEQ ID NO: 167621
  derived and/or modified sequence opt4 from neuraminidase__InfluenzaA__AFH00112

SEQ ID NO: 174600 - RNA, 1410 nt, Artificial Sequence; identical to SEQ ID NO: 167621
  derived and/or modified sequence opt4 from neuraminidase__InfluenzaA__AFH00123

SEQ ID NO: 174601 - RNA, 1410 nt, Artificial Sequence
  derived and/or modified sequence opt4 from neuraminidase__InfluenzaA__AFH00156
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucaucgacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174602 - RNA, 1410 nt, Artificial Sequence
  derived and/or modified sequence opt4 from neuraminidase__InfluenzaA__AFH00167
augaaccccaaccagaagaucaucaccaucggcagcgugagccugaccaucgccaccaugugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174603 - RNA, 1410 nt, Artificial Sequence; identical to SEQ ID NO: 174601
  derived and/or modified sequence opt4 from neuraminidase__InfluenzaA__AFH00178

SEQ ID NO: 174604 - RNA, 1410 nt, Artificial Sequence
  derived and/or modified sequence opt4 from neuraminidase__InfluenzaA__AFH00189
augaaccccaaccagaagaucaucaccaucggcagcgugagccugaccaucgccaccaucugcuuccugaugcagaucgccauccuggugaccaccgugacccugcacuucaagcaguacgaguacaacagcccccccaacaaccaggugaugcugugcgagcccaagaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174605 - RNA, 1410 nt, Artificial Sequence; identical to SEQ ID NO: 167705
  derived and/or modified sequence opt4 from neuraminidase__InfluenzaA__AFH00200

SEQ ID NO: 174606 - RNA, 1410 nt, Artificial Sequence; identical to SEQ ID NO: 174602
  derived and/or modified sequence opt4 from neuraminidase__InfluenzaA__AFH00211

SEQ ID NO: 174607 - RNA, 1410 nt, Artificial Sequence
  derived and/or modified sequence opt4 from neuraminidase__InfluenzaA__AFH00222
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacaacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174608 - RNA, 1410 nt, Artificial Sequence; identical to SEQ ID NO: 167621
  derived and/or modified sequence opt4 from neuraminidase__InfluenzaA__AFH00233

SEQ ID NO: 174609 - RNA, 1410 nt, Artificial Sequence
  derived and/or modified sequence opt4 from neuraminidase__InfluenzaA__AFH00244
augaaccccaaccagaagaucaucaccaucggcagcgugagccugaccaucgccaccaucugcuuccugaugcagaucgccauccuggugaccaccgugacccuguacuucaagcaguacgagugcaacagcccccccagcaaccaggugaugcugugcgagcccaccaucguggagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgccaagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174610 - RNA, 1410 nt, Artificial Sequence; identical to SEQ ID NO: 167705
  derived and/or modified sequence opt4 from neuraminidase__InfluenzaA__AFH00255

SEQ ID NO: 174611 - RNA, 1410 nt, Artificial Sequence; identical to SEQ ID NO: 167705
  derived and/or modified sequence opt4 from neuraminidase__InfluenzaA__AFH00266

SEQ ID NO: 174612 - RNA, 1410 nt, Artificial Sequence
  derived and/or modified sequence opt4 from neuraminidase__InfluenzaA__AFH00277
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaagcccaacaacgagaagggcagccacggccugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174613 - RNA, 1410 nt, Artificial Sequence; identical to SEQ ID NO: 167705
  derived and/or modified sequence opt4 from neuraminidase__InfluenzaA__AFH00288

SEQ ID NO: 174614 - RNA, 1410 nt, Artificial Sequence; identical to SEQ ID NO: 174537
  derived and/or modified sequence opt4 from neuraminidase__InfluenzaA__AFH00299

SEQ ID NO: 174615 - RNA, 1410 nt, Artificial Sequence
  derived and/or modified sequence opt4 from neuraminidase__InfluenzaA__AFH00310
augaaccccaaccagaagaucaucaccaucggcagcgugagccugaccaucgccaccaucugcuuccugaugcagaucgccauccuggugaccaccgugacccugcacuucaagcaguacgagugcagcagcagccccaacaaccaggugauccccugccagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagaaggccgacaccaagauccuguucaucgaggagggcaagguggugcacaucagcccccugagcggcagcgcccagcacguggaggagugcagcugcuaccccagauaccccggcgugagaugcgugugcagagacaacuggaagggcagcaacagacccaucguggacaucaacgugaagaacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccaaggugugguggaccagcaacagccuggugguguucugcggcaccagcggcaccuacggcaccggcagcuggcccgacggcgccgacaucaaccugaugcccaucuga

SEQ ID NO: 174616 - RNA, 1410 nt, Artificial Sequence; identical to SEQ ID NO: 174615
  derived and/or modified sequence opt4 from neuraminidase__InfluenzaA__AFH00321

SEQ ID NO: 174617 - RNA, 1410 nt, Artificial Sequence
  derived and/or modified sequence opt4 from neuraminidase__InfluenzaA__AFH00332
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagggcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174618 - RNA, 1410 nt, Artificial Sequence
  derived and/or modified sequence opt4 from neuraminidase__InfluenzaA__AFH00343
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggccaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174619 - RNA, 1410 nt, Artificial Sequence
  derived and/or modified sequence opt4 from neuraminidase__InfluenzaA__AFH00354
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccaagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174620 - RNA, 1410 nt, Artificial Sequence; identical to SEQ ID NO: 167500
  derived and/or modified sequence opt4 from neuraminidase__InfluenzaA__AFH00365

SEQ ID NO: 174621 - RNA, 1410 nt, Artificial Sequence
  derived and/or modified sequence opt4 from neuraminidase__InfluenzaA__AFH00376
augaaccccaaccagaagaucaucaccaucggcagcgugagccugaccaucgccaccaucugcuuccugaugcagaucgccauccuggugaccaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174622 - RNA, 1410 nt, Artificial Sequence
  derived and/or modified sequence opt4 from neuraminidase__InfluenzaA__AFH00387
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucagcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174623 - RNA, 1410 nt, Artificial Sequence
  derived and/or modified sequence opt4 from neuraminidase__InfluenzaA__AFH00398
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcgccggcagcuggcccgacggcgccgacaucaaccugaugcccaucuga

SEQ ID NO: 174624 - RNA, 1410 nt, Artificial Sequence
  derived and/or modified sequence opt4 from neuraminidase__InfluenzaA__AFH00409
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174625 - RNA, 1410 nt, Artificial Sequence; identical to SEQ ID NO: 167500
  derived and/or modified sequence opt4 from neuraminidase__InfluenzaA__AFH00420

SEQ ID NO: 174626 - RNA, 1410 nt, Artificial Sequence; identical to SEQ ID NO: 167633
  derived and/or modified sequence opt4 from neuraminidase__InfluenzaA__AFH00431

SEQ ID NO: 174627 - RNA, 1410 nt, Artificial Sequence
  derived and/or modified sequence opt4 from neuraminidase__InfluenzaA__AFH00442
augaaccccaaccagaagaucaucaccaucggcagcgugagccugaccaucgccaccaucugcuuccugaugcagaucgccauccuggugaucaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174628 - RNA, 1410 nt, Artificial Sequence
  derived and/or modified sequence opt4 from neuraminidase__InfluenzaA__AFH00453
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgaggugguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaucgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174629 - RNA, 1410 nt, Artificial Sequence
  derived and/or modified sequence opt4 from neuraminidase__InfluenzaA__AFH00464
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaagaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174630 - RNA, 1410 nt, Artificial Sequence
  derived and/or modified sequence opt4 from neuraminidase__InfluenzaA__AFH00475
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcaaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174631 - RNA, 1410 nt, Artificial Sequence
  derived and/or modified sequence opt4 from neuraminidase__InfluenzaA__AFH00486
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga
